United States Patent 7,608,276 (STAPHYLOCOCCUS AUREUS PROTEINS AND NUCLEIC ACIDS) - sequence listing, part 2

SEQ ID NO: 4281 - DNA, 1206 bp, Staphylococcus aureus
ttgaatgaaaatgaaaagaatataagaaagaattttttaaaatttaccgaatcacggtatatgaagtttgttggtgggaatgatttagtcttctcattaatagcgctagtattgttgggtattgttatttttattttcgaaaaagtatcatatgtttttgatccttttatcatcgtttttaagacgatagcagcacctatcatcgtctctttaattctattctatctatttaacccaatcgtaaatatgatggaacgttatagaataccaagagttgcaggtatttctattatttatctagctgtagtaggtgttattacgttaattgttaatttattgatacctattattggttcgcaagtagatagtttagttaaaaattcaccgcaatatctagaaaaattaattaattctattgataaaatagcaaataatacgtttttctcttcgtattatagtcaaattaatgattggttaaattctttacctaagaaaataccatctatgttaagtgaatttacagatggctttgggtctaaaattgcaacgtttgcagaaacgattgctaatattggcgttgtgattgtcacaacaccatttgtactattctttatgcttaaagatggacatcacttcaaagaattttcaacgaatattatgccaccgaaattccgaaaagattttcatgatctacttgaaaaaatgagtgttcaagttggttcatacattcaaggacaaattatcgtttcattctgtatcggtatactgttgtttatcggttattcggttatcgggttgaaatatagcttagtattagctagtattgcggcagttacaagtgttgtaccatatttagggcctactatagcgatttctccagctattgtaatagctgctataacatcgccgtggatgctcttaaaattagcagtagtatggactttagtacaatttgttgaagggcacttcatttcaccaaatatcatgggtaaaacacttaagattcatccacttacaatcattttcattttactgtgtgcaggcaaattgcttggtattgtaggcgttattttaggtattccgggatatgctattttaaaagtattagttactcatttattccaattatttaaacgtcgatacaatcgtttctatggtaatgatgtaggtgaatatgatattaaagaaagtaataaaatagttgaa

SEQ ID NO: 4282 - protein, 402 aa, Staphylococcus aureus
  MISC_FEATURE (1)..(402): conserved hypothetical
LNENEKNIRKNFLKFTESRYMKFVGGNDLVFSLIALVLLGIVIFIFEKVSYVFDPFIIVFKTIAAPIIVSLILFYLFNPIVNMMERYRIPRVAGISIIYLAVVGVITLIVNLLIPIIGSQVDSLVKNSPQYLEKLINSIDKIANNTFFSSYYSQINDWLNSLPKKIPSMLSEFTDGFGSKIATFAETIANIGVVIVTTPFVLFFMLKDGHHFKEFSTNIMPPKFRKDFHDLLEKMSVQVGSYIQGQIIVSFCIGILLFIGYSVIGLKYSLVLASIAAVTSVVPYLGPTIAISPAIVIAAITSPWMLLKLAVVWTLVQFVEGHFISPNIMGKTLKIHPLTIIFILLCAGKLLGIVGVILGIPGYAILKVLVTHLFQLFKRRYNRFYGNDVGEYDIKESNKIVE

SEQ ID NO: 4283 - DNA, 165 bp, Staphylococcus aureus
ttgaagaaaggattaatcaatcctaaattaagtgtattacacgggcgtttcgttactgtaaagggtatttgtatggtatcattgatgttagtaattttacataagtggactgtttttatacaacatcttatgaatattttaagtggtggtgaatctataattgaa

SEQ ID NO: 4284 - protein, 55 aa, Staphylococcus aureus
  MISC_FEATURE (1)..(55): hypothetical protein
LKKGLINPKLSVLHGRFVTVKGICMVSLMLVILHKWTVFIQHLMNILSGGESIIE

SEQ ID NO: 4285 - DNA, 858 bp, Staphylococcus aureus
gtgatgataatgggagaatatattgttactaaaacattgaacaacaatgtcgtagtatgtactaataatgatcaagaagttattttaatcggtaaaggtattggttttaacaaaaaagagggaatggcgttaaacgaccaaactattacaatagagaaaatttataaattagaaagtgagcaacaaaaagcacattataaaagtttagttgaaatcgctgatgataatgtattacaagtaattattgattcgttgaattttatttctaatactgcgatgaatgttgattcaaaacaacttgtagtttcattaacggatcatattatatttgcttataaacgcttaaaacaaaatcaagttattagcaatccatttgttatggaaactatgcagttatatagtgatgcatatcatattgctaaacaggtgattgatcagttaaatgcagcattagatgtacattttcctgaagatgagataggatttattgcattacatattgcatctaatacagaagatttatctatgcatgagatgaccttgatcaataatgttattaaaaaaggtatagatatcattgaatcagaccttgtgacaactgttgataaggaatcattacaataccaacgttttataaggcacgtacaatttttaattcgccgattaagaagaaaagaatatatacatgcacaagatgattttgtgtctatgattaaaaatcactatccgatttgctataacacagcatataaaattttaactatgatacaaaaacaatttgatgttaatatcagtgagtctgaaattatatatttaacattacacattcatcattttgaagaaaggattaatcaatcc

SEQ ID NO: 4286 - protein, 286 aa, Staphylococcus aureus
  MISC_FEATURE (1)..(286): transcription
VMIMGEYIVTKTLNNNVVVCTNNDQEVILIGKGIGFNKKEGMALNDQTITIEKIYKLESEQQKAHYKSLVEIADDNVLQVIIDSLNFISNTAMNVDSKQLVVSLTDHIIFAYKRLKQNQVISNPFVMETMQLYSDAYHIAKQVIDQLNAALDVHFPEDEIGFIALHIASNTEDLSMHEMTLINNVIKKGIDIIESDLVTTVDKESLQYQRFIRHVQFLIRRLRRKEYIHAQDDFVSMIKNHYPICYNTAYKILTMIQKQFDVNISESEIIYLTLHIHHFEERINQS

SEQ ID NO: 4287 - DNA, 1362 bp, Staphylococcus aureus
ttgacagctggattcttctttacgattagttctaaattcgttcaattacgaatgttacctgaaatgtttagagctttagtagaacgtccagaaactttagaagatggtaagaagggtatttcgccattccaagcatttgcgattagtgctggttcgagagttggtactggtaatattgctggtgttgcgactgcgattgttttaggcggtccaggtgcagtattttggatgtgggttattgcatttataggtgcagcgagtgcatttatagaagcgactttggctcaggtttataaagtacatgataaagatggtggattccgtggtggtccagcttactatattactaaaggtttaaatcaaaaatggctaggtatcgtatttgcgattttaattacaattacatttgcatttgtatttaacacagtgcaatctaatacaattgcggagtcgttaaatacgcaatataatattagtccagtaatcacaggtattattttagcaatcgtaacagctattattatatttggtggtgtacgtagtattgctacgttatcttcgttaattgtaccgattatggctatcatttacattggtatggttttagtaatattgctatttaatttagatcaaattgttcctatgataggtacgattattaaaagtgcatttggtatcgaacaagtaactggtggcgctgtaggtgctgcggttcttcaaggtatcaaacgtggtttattctctaacgaagctggtatgggttctgcgccgaatgcagcggcaactgctgccgtaccacaccctgttaagcaaggtttaatccaatcattaggtgtgttctttgatacaatgttggtttgtacagcaactgcaatcatgattttactatattcaggactgaaatttggtgataacgcacctcaaggtgttgcagttactcaatcagcacttaatgagcatttaggttctgctggaggtattttcttaacaatagcagttacactgtttgcattttcatctgttgtaggtaattactattacggtcaatctaatattgaatttttatcaacaaaccgtgtaatattatttatctttagatgtcttgttgtagtacttgtctttgtcggtgcagttgtaaaaacagaaacagtatggaatacggcagacttatttatgggcttaatggcaattgtaaacattatttccattataggactgtccaatgtagcttttgcattgatgaaagattatcaaaagcagaaaaaagaaggcaagaaccctgtctttaaacctgaaaacttagaaattaacttatttggaattagtgcttggggcgctaacaaatataagaactctgataaa

SEQ ID NO: 4288 - protein, 454 aa, Staphylococcus aureus
  MISC_FEATURE (1)..(454): amino acid carrier protein
LTAGFFFTISSKFVQLRMLPEMFRALVERPETLEDGKKGISPFQAFAISAGSRVGTGNIAGVATAIVLGGPGAVFWMWVIAFIGAASAFIEATLAQVYKVHDKDGGFRGGPAYYITKGLNQKWLGIVFAILITITFAFVFNTVQSNTIAESLNTQYNISPVITGIILAIVTAIIIFGGVRSIATLSSLIVPIMAIIYIGMVLVILLFNLDQIVPMIGTIIKSAFGIEQVTGGAVGAAVLQGIKRGLFSNEAGMGSAPNAAATAAVPHPVKQGLIQSLGVFFDTMLVCTATAIMILLYSGLKFGDNAPQGVAVTQSALNEHLGSAGGIFLTIAVTLFAFSSVVGNYYYGQSNIEFLSTNRVILFIFRCLVVVLVFVGAVVKTETVWNTADLFMGLMAIVNIISIIGLSNVAFALMKDYQKQKKEGKNPVFKPENLEINLFGISAWGANKYKNSDK

SEQ ID NO: 4289 - DNA, 96 bp, Staphylococcus aureus
atgaatcatgtaccttctataaaattagaccgaattgaaccttcagtaaatatagagatacatcatcatttcttatacaatacaagagatttatat

SEQ ID NO: 4290 - protein, 32 aa, Staphylococcus aureus
MNHVPSIKLDRIEPSVNIEIHHHFLYNTRDLY

SEQ ID NO: 4291 - DNA, 2400 bp, Staphylococcus aureus
gtgagtgaaataattcaagatttatcacttgaagatgttttaggtgatcgctttggaagatatagtaaatatattattcaagagcgtgcattgccagatgttcgtgatggtttaaaaccagtacaacgtcgtattttatatgcaatgtattcaagtggtaatacacacgataaaaatttccgtaaaagtgcgaaaacagtcggtgatgttattggtcaatatcatccacatggagactcctcagtgtacgaagcaatggtccgtttaagtcaagactggaagttacgacatgtcttaatagaaatgcatggtaataatggtagtatcgataatgatccgccagcggcaatgcgttacactgaagctaagttaagcttactagctgaagagttattacgtgatattaataaagagacagtttctttcattccaaactatgatgatacgacactcgaaccaatggtattgccatcaagatttcctaacttactagtgaatggttctacaggtatatctgcaggttacgcgacagatataccaccacataatttagctgaagtgattcaagcaacacttaaatatattgataatccggatattacagtcaatcaattaatgaaatatattaaaggtcctgattttccaactggtggtattattcaaggtattgatggtattaaaaaagcttatgaatcaggtaaaggtagaattatagttcgttctaaagttgaagaagaaactttacgcaatggacgtaaacagttaattattactgaaattccatatgaagtgaacaaaagtagcttagtaaaacgtatcgatgaattacgtgctgacaaaaaagtcgatggtatcgttgaagtacgtgatgaaactgatagaactggtttacgaatagcaattgaattgaaaaaagatgtgaacagtgaatcaatcaaaaattatctttataaaaactctgatttacagatttcatataatttcaacatggtcgctattagtgatggtcgtccaaaattgatgggtattcgtcaaattatagatagttatttgaatcaccaaattgaggttgttgcaaatagaacgaagtttgaattagataatgcagaaaaacgtatgcatatcgttgaaggtttgattaaagcgttgtcaattttagataaagtaatcgaattgattcgtagctctaaaaacaagcgtgacgctaaagaaaaccttatcgaagtatacgagttcacagaagaacaggctgaagcaattgtaatgttacagttatatcgtttaacaaatactgacatagttgcgcttgaaggtgaacataaagaacttgaagcattaatcaaacaattacgtcatattcttgataaccatgatgcattattgaatgtcataaaagaagaattgaatgaaattaaaaagaaattcaaatctgaacgactgtctttaattgaagcagaaattgaagaaattaaaattgacaaagaagttatggtgcctagtgaagaagttattttaagtatgacacgtcatggatatattaaacgtacttctattcgtagctttaatgctagcggtgttgaagatattggtttaaaagatggtgacagtttacttaaacatcaagaagtaaatacgcaagataccgtactagtatttacaaataaaggtcgttatctatttataccggttcataaattagcagatattcgttggaaagaattgggacaacatgtatcacaaatagttcctatcgaagaagatgaagtggttattaatgtctttaatgaaaaggactttaatacagatgcattttatgtttttgcgactcaaaatggcatgattaagaaaagtacagtgcctctatttaaaacaacgcgttttaataaacctttaattgctactaaagttaaagaaaatgatgatttgattagtgttatgcgctttgaaaaagatcaattaattaccgtcattactaataaaggtatgtcattaacgtataatacaagtgaactatcagataccggattaagggcagctggtgttaaatcaataaatcttaaagctgaagatttcgttgttatgacagaaggtgtttctgaaaatgatactatattgatggccacacaacgcggctcgttaaaacgtattagttttaaaatcttacaagttgctaaaagagcacaacgtggaataactttattaaaagaattaaagaaaaatccacatcgtattgtagctgcacatgtagtgacaggtgaacatagtcaatatacattatattcaaaatcaaatgaagaacatggtttaattaatgatattcataaatctgaacaatatacaaatggctcattcattgtagatacagatgattttggtgaagtaatagacatgtatattagc

SEQ ID NO: 4292 - protein, 800 aa, Staphylococcus aureus
  MISC_FEATURE (1)..(800): topoisomerase IV subunit A
VSEIIQDLSLEDVLGDRFGRYSKYIIQERALPDVRDGLKPVQRRILYAMYSSGNTHDKNFRKSAKTVGDVIGQYHPHGDSSVYEAMVRLSQDWKLRHVLIEMHGNNGSIDNDPPAAMRYTEAKLSLLAEELLRDINKETVSFIPNYDDTTLEPMVLPSRFPNLLVNGSTGISAGYATDIPPHNLAEVIQATLKYIDNPDITVNQLMKYIKGPDFPTGGIIQGIDGIKKAYESGKGRIIVRSKVEEETLRNGRKQLIITEIPYEVNKSSLVKRIDELRADKKVDGIVEVRDETDRTGLRIAIELKKDVNSESIKNYLYKNSDLQISYNFNMVAISDGRPKLMGIRQIIDSYLNHQIEVVANRTKFELDNAEKRMHIVEGLIKALSILDKVIELIRSSKNKRDAKENLIEVYEFTEEQAEAIVMLQLYRLTNTDIVALEGEHKELEALIKQLRHILDNHDALLNVIKEELNEIKKKFKSERLSLIEAEIEEIKIDKEVMVPSEEVILSMTRHGYIKRTSIRSFNASGVEDIGLKDGDSLLKHQEVNTQDTVLVFTNKGRYLFIPVHKLADIRWKELGQHVSQIVPIEEDEVVINVFNEKDFNTDAFYVFATQNGMIKKSTVPLFKTTRFNKPLIATKVKENDDLISVMRFEKDQLITVITNKGMSLTYNTSELSDTGLRAAGVKSINLKAEDFVVMTEGVSENDTILMATQRGSLKRISFKILQVAKRAQRGITLLKELKKNPHRIVAAHVVTGEHSQYTLYSKSNEEHGLINDIHKSEQYTNGSFIVDTDDFGEVIDMYIS

SEQ ID NO: 4293 - DNA, 945 bp, Staphylococcus aureus
ttgtattcaatgagtaatcaatatcagcaatattctacagttaagaaatattggcatttaatgcgtcctcatacattaactgcttccgtagtacccgttttagttggtacagcagcatctaaaatatattttcttggtagcgaagatcatattaaaatcagcctattcattgccatgttactagcatgcttacttattcaagcagcaactaatatgtttaatgaatactatgattataaaaaaggcctcgatgatcatgaatctgtaggcattggtggtgccattgttcgcaacggtatgagcccagagcttgtgctacgattagccattgcattttacatcttagcagcaatattaggtttgtttttagctgctaactcttcattttggttattaccagttggattagtatgtatggctgttggttacctatatacaggtggccctttccctatttcatggacgcctttcggtgaattattctcaggcgtatttatgggtatgtttattatcgttattgcattctttattcaaactggcaatattcaaagttatgtaatttggttaagtgtacctatagtaatcactatcggtttaattaatatggctaacaatattcgcgaccgtgtcaaagataaagcaagtggtcgcaaaactttacccattctattaggtaaaaatgcttctttaacatttatggcaatcatgtactttatcgcttatgcctttattgtacttacgatcattattaaacctggtggctcattattttacttacttgcgttgttatcattcccaatgcctgttaaagttatcagacgtttcaagaagaatgatacaccgcctacaatgatgccagcaatggctgctgctggtaaaacaaatacatttttcggtttattatatgcattaggtatttatattagtgcattatttgcaggcatt

SEQ ID NO: 4294 - protein, 315 aa, Staphylococcus aureus
  MISC_FEATURE (1)..(315): hypothetical protein
LYSMSNQYQQYSTVKKYWHLMRPHTLTASVVPVLVGTAASKIYFLGSEDHIKISLFIAMLLACLLIQAATNMFNEYYDYKKGLDDHESVGIGGAIVRNGMSPELVLRLAIAFYILAAILGLFLAANSSFWLLPVGLVCMAVGYLYTGGPFPISWTPFGELFSGVFMGMFIIVIAFFIQTGNIQSYVIWLSVPIVITIGLINMANNIRDRVKDKASGRKTLPILLGKNASLTFMAIMYFIAYAFIVLTIIIKPGGSLFYLLALLSFPMPVKVIRRFKKNDTPPTMMPAMAAAGKTNTFFGLLYALGIYISALFAGI

SEQ ID NO: 4295 - DNA, 102 bp, Staphylococcus aureus
gtgaaaaaagacgaagaaagaagtgaaatggatggctacgggcgtattagaggacgatattgtcaaagagatatatggcagctcaaaggaatgggtttcagt

SEQ ID NO: 4296 - protein, 34 aa, Staphylococcus aureus
VKKDEERSEMDGYGRIRGRYCQRDIWQLKGMGFS

SEQ ID NO: 4297 - DNA, 2082 bp, Staphylococcus aureus
ttgatacttgcattttacgctgatttatataagaataactattgtatagttttaaaaacgaacgtacgtttgcaggaggcgaaatcattggcaatgaataaacaaaataattattcagatgattcaatacaggttttagaggggttagaagcagttcgtaaaagacctggtatgtatattggatcaactgataaacggggattacatcatctagtatatgaaattgtcgataactccgtcgatgaagtattgaatggttacggtaacgaaatagatgtaacaattaataaagatggtagtatttctatagaagataatggacgtggtatgccaacaggtatacataaatcaggtaaaccgacagtcgaagttatctttactgttttacatgcaggaggtaaatttggacaaggcggctataaaacttcaggtggtcttcacggtgttggtgcttcagttgtaaatgcattgagtgaatggcttgaagttgaaatccatcgagatggtaatatatatcatcaaagttttaaaaacggtggttcgccatcttctggtttagtgaaaaaaggtaaaactaagaaaacaggtaccaaagtaacatttaaacctgatgacacaatttttaaagcatctacatcatttaattttgatgttttaagtgaacgactacaagagtctgcgttcttattgaaaaatttaaaaataacgcttaatgatttacgcagtggtaaagagcgtcaagagcattaccattatgaagaaggaatcaaagagtttgttagttatgtcaatgaaggaaaagaagttttgcatgacgtggctacattttcaggtgaagcaaatggtatagaggtagacgtagctttccaatataatgatcaatattcagaaagtattttaagttttgtaaataatgtacgtactaaagatggtggtacacatgaagttggttttaaaacagcaatgacacgtgtatttaatgattatgcacgtcgtattaatgaacttaaaacaaaagataaaaacttagatggtaatgatattcgtgaaggtttaacagctgttgtgtctgttcgtattccagaagaattattgcaatttgaaggacaaacgaaatctaaattgggtacttctgaagctagaagtgctgttgattcagttgttgcagacaaattgccattctatttagaagaaaaaggacaattgtctaaatcacttgtgaaaaaagcgattaaagcacaacaagcaagggaagctgcacgtaaagctcgtgaagatgctcgttcaggtaagaaaaacaagcgtaaagacactttgctatctggtaaattaacacctgcacaaagtaaaaacactgaaaaaaatgaattgtatttagtcgaaggtgattctgcgggaggttcagcaaaacttggacgagaccgcaaattccaagcgatattaccattacgtggtaaggtaattaatacagagaaagcacgtctagaagatatttttaaaaatgaagaaattaatacaattatccacacaatcggggcaggcgttggtactgactttaaaattgaagatagtaattataatcgtgtaattattatgactgatgctgatactgatggtgcgcatattcaagtgctattgttaacattcttcttcaaatatatgaaaccgcttgttcaagcaggtcgtgtatttattgctttacctccactttataaattggaaaaaggtaaaggcaaaacaaagcgagttgaatacgcttggacagacgaagagcttaataaattgcaaaaagaacttggtaaaggcttcacgttacaacgttacaaaggtttgggtgaaatgaaccctgaacaattatgggaaacgacgatgaacccagaaacacgaactttaattcgtgtacaagttgaagatgaagtgcgttcatctaaacgtgtaacaacattaatgggtgacaaagtacaacctagacgtgaatggattgaaaagcatgttgagtttggtatgcaagaggaccaaagtattttagataattctgaagtacaagtgcttgaaaatgatcaatttgatgaggaggaaatc

SEQ ID NO: 4298 - protein, 694 aa, Staphylococcus aureus
  MISC_FEATURE (1)..(694): topoisomerase IV subunit B
LILAFYADLYKNNYCIVLKTNVRLQEAKSLAMNKQNNYSDDSIQVLEGLEAVRKRPGMYIGSTDKRGLHHLVYEIVDNSVDEVLNGYGNEIDVTINKDGSISIEDNGRGMPTGIHKSGKPTVEVIFTVLHAGGKFGQGGYKTSGGLHGVGASVVNALSEWLEVEIHRDGNIYHQSFKNGGSPSSGLVKKGKTKKTGTKVTFKPDDTIFKASTSFNFDVLSERLQESAFLLKNLKITLNDLRSGKERQEHYHYEEGIKEFVSYVNEGKEVLHDVATFSGEANGIEVDVAFQYNDQYSESILSFVNNVRTKDGGTHEVGFKTAMTRVFNDYARRINELKTKDKNLDGNDIREGLTAVVSVRIPEELLQFEGQTKSKLGTSEARSAVDSVVADKLPFYLEEKGQLSKSLVKKAIKAQQAREAARKAREDARSGKKNKRKDTLLSGKLTPAQSKNTEKNELYLVEGDSAGGSAKLGRDRKFQAILPLRGKVINTEKARLEDIFKNEEINTIIHTIGAGVGTDFKIEDSNYNRVIIMTDADTDGAHIQVLLLTFFFKYMKPLVQAGRVFIALPPLYKLEKGKGKTKRVEYAWTDEELNKLQKELGKGFTLQRYKGLGEMNPEQLWETTMNPETRTLIRVQVEDEVRSSKRVTTLMGDKVQPRREWIEKHVEFGMQEDQSILDNSEVQVLENDQFDEEEI

SEQ ID NO: 4299 - DNA, 606 bp, Staphylococcus aureus
atgatgataatcgtcatgttactactaagttatcttatcggcgctttcccaagtggattcgtaattggaaaattatttttcaaaaaagatattagacaatttggtagtggtaatactggcgctactaatagctttagagtattaggtcgtcctgcaggattcttggtaacatttctagatattttcaaagggttcataactgttttcttccctttatggttacaagttcacgcagatggccctattagtactttttttacaaatggtttaattgttggcttattcgctatacttggacacgtttatcctgtttatttaaaattccaaggtggcaaagctgttgcaactagtgcaggtgtcgtcttgggagtcaatccgatacttttactaatacttgcaattatcttctttattgtattgaagatttttaaatatgtttctttagcaagtatcgttgcagcaatttgctgtgtgattggctcgcttatcattcaagactatattttattagtcgttagtttcttagtttcaatcatattgataattagacatcgctctaatatcgcaaggatttttagaggcgaagaacctaaaataaaatggatg

SEQ ID NO: 4300 - protein, 202 aa, Staphylococcus aureus
  MISC_FEATURE (1)..(202): conserved hypothetical
MMIIVMLLLSYLIGAFPSGFVIGKLFFKKDIRQFGSGNTGATNSFRVLGRPAGFLVTFLDIFKGFITVFFPLWLQVHADGPISTFFTNGLIVGLFAILGHVYPVYLKFQGGKAVATSAGVVLGVNPILLLILAIIFFIVLKIFKYVSLASIVAAICCVIGSLIIQDYILLVVSFLVSIILIIRHRSNIARIFRGEEPKIKWM

SEQ ID NO: 4301 - DNA, 378 bp, Staphylococcus aureus
ttgttgttcatagccaatatcaacatcttcctttggttcaactgtaaaagcaggactaaatccttgcttgagttggaattcgccaccatatcttacaaaaaacacgagcactttattattttcaggcaactcaagttcatttttaaaccaagttactgctgcatcagtaagttctatttgcataacaatgacctcctatatttattacagaatgggagtgggccaacttgtattatttgtggaatttcttatcgaaattctctgcgttggagcccaccccaacctgctcattattgtaagctgaatttccataagcttctatgttgggacccccgaccagaattgaaaaaacctagttataagcgcattttgttcggt

SEQ ID NO: 4302 - protein, 126 aa, Staphylococcus aureus
LLFIANINIFLWFNCKSRTKSLLELEFATISYKKHEHFIIFRQLKFIFKPSYCCISKFYLHNNDLLYLLQNGSGPTCIICGISYRNSLRWSPPQPAHYCKLNFHKLLCWDPRPELKKPSYKRILFG

SEQ ID NO: 4303 - DNA, 294 bp, Staphylococcus aureus
atgcaaatagaacttactgatgcagcagtaacttggtttaaaaatgaacttgagttgcctgaaaataataaagtgctcgtgttttttgtaagatatggtggcgaattccaactcaagcaaggatttagtcctgcttttacagttgaaccaaaggaagatgttgatattggctatgaacaacaatatgacgatttaaatgttgtcgtagcggaaaaagatttgtggtactttgaagatgaccacattattgtaaatgtagttgatcacgaagatgaaatttcttattccacaaaa

SEQ ID NO: 4304 - protein, 98 aa, Staphylococcus aureus
  MISC_FEATURE (1)..(98): conserved hypothetical
MQIELTDAAVTWFKNELELPENNKVLVFFVRYGGEFQLKQGFSPAFTVEPKEDVDIGYEQQYDDLNVVVAEKDLWYFEDDHIIVNVVDHEDEISYSTK

SEQ ID NO: 4305 - DNA, 465 bp, Staphylococcus aureus
atgatatatagtattacagaaatagaagcgcgttatgctgaaactgataagatgggtgtaatttatcacgggaattatgcaacttggtttgaagttgcgcggttggattatatatcgaagttaggttttagttatgctgatatggaaaaacaaggaatcatttcacctgtgactgacctcaatgtcaattataaaaagtctattttttatccagaaaaagttaaagttaaaacttgggttgaaaaatattcgagattacgttcagtgtataaatatgagatttttaatgaaaaaggtgaacttgcaactacaggttccacagaattgatttgcattaaagaagatacttttaagcctatacggttggatcgttatttcccagattggcatgaagcttatagtaaagtgcaaacgctcaataatgaagggaaaacagtagagataatggatggtattgattcttta

SEQ ID NO: 4306 - protein, 155 aa, Staphylococcus aureus
  MISC_FEATURE (1)..(155): conserved hypothetical
MIYSITEIEARYAETDKMGVIYHGNYATWFEVARLDYISKLGFSYADMEKQGIISPVTDLNVNYKKSIFYPEKVKVKTWVEKYSRLRSVYKYEIFNEKGELATTGSTELICIKEDTFKPIRLDRYFPDWHEAYSKVQTLNNEGKTVEIMDGIDSL

SEQ ID NO: 4307 - DNA, 2703 bp, Staphylococcus aureus
atggctgcaaattttaaagagcaatcaaaaaaacattttgacttgaatggccaaagttatacttactatgatttaaaagctgtagaagagcaaggtattactaaagtttccaatttaccttattcaattcgtgttttgttagaatctttacttcgtcaagaagatgattttgtaattacagacgatcatattaaagctttaagtcagtttggaaaagatggaaatgaaggcgaggtaccatttaaaccttctcgtgttattttacaagatttcacaggtgtaccagccgtagttgatttagcttctttacgtaaagcaatggatgacgttgggggagatattactaaaattaatccagaagtaccggtggatttagttattgaccactcagttcaagtggatagctatgcaaatccagaagctcttgaacgtaatatgaaattagaatttgaacgtaactatgaacgttatcagtttttaaattgggcaacgaaagcatttgataattacaatgcagttcctcctgcaactggaatagttcaccaagttaacttagaatatttagcaagtgttgtacatgttcgtgatgtagatggtgaaaaaactgcatttccagatacattagttggtactgattcacatacaacaatgataaatggtattggcgtactaggatggggtgttggtggtattgaagctgaagctggaatgcttggacaaccttcttatttcccaattccagaggttattggtgtacgactagtaaattcattaccacaaggcgcaacagcaactgatttagcgttaagagtaactcaagagctacgtaaaaaaggtgttgttggtaaatttgtggagttctttggtccaggtgtacaacatttaccactagcagaccgtgctacaattgcaaacatggcaccagagtatggagcaacttgcggattcttcccagttgatgatgaatctcttaaatatatgaagttaactggtagatcagacgaacatatcgcgctagtaaaagaatatttgaaacaaaaccatatgttctttgatgttgagaaagaagatcctaattatacagatgttatcgaattggatttatcaacagttgaagcatcgctttcaggaccaaaacgtcctcaagatttaattttcttaagtgatatgaaatcatcatttgaaaattctgtaacagctccagcaggcaaccaaggacacggtttagataaaagtgaatttgataagaaagctgaaattaactttaaagatggatcaaaagctacaatgaaaacaggtgatattgcaatagcagcaattacatcatgtacaaatacatctaacccttatgtaatgttaggtgcaggtttagttgctaaaaaagcagttgaaaaaggcttgaaagttcctgaatacgttaaaacttctctagcaccaggatcaaaagttgttaccggatatttaagagatgctggcttacaaccttatttagatgatttaggcttcaacttggttggttatggatgtacaacttgtatcggtaattcaggtcctttattaccagaaattgaaaaagcgattgctgatgaggacctattagtgacatctgtattatctggtaaccgtaactttgaaggtcgtatccatcctcttgttaaagccaattacctagcttcaccacagttagttgttgcttatgcattagctggaacggttgatattgatttacaaaatgaacctattggtaaaggtaatgacggtgaagatgtatatttgaaagatatttggccatcaattaaagaagtttcagataccgttgatagtgttgtaacacctgaattatttattgaagaatataataacgtatacaataacaacgaattatggaatgagattgatgtaactgatcaacctctatatgactttgatcctaattcaacatacattcaaaatccatcattcttccaaggattatctaaagaaccgggtacgattgttccattaaatggtttacgtgttatgggtaaattcggtgattctgtgacaactgaccacatctctccagcaggtgcaattggtaaagatacgccagctggtaaatatttacaagatcatcaagtgcctattcgtgaatttaattcatatggttcaagacgtggtaatcacgaagtaatggttcgaggtacgtttgctaatatacgtattaaaaaccaattagcgccaggtactgaaggtggttttacaacttattggccaacaaatgaagtaatgcctatctttgatgctgcaatgaaatataaagaagatggtacaggtttagttgtattagctggtaacgattatggtatgggttcatctcgtgactgggcagcaaaaggtacaaacttattaggtgttaaaacagttattgcacaaagttatgaacgtatccatcgttcaaatttagttatgatgggtgtattaccattagagtttaaaaaaggtgaatcagctgattctcttggtctagatggtacagaagaaatttctgttaatattgatgaaaatgttcaaccacatgactacgtcaaagttactgctaagaagcaagatggtgatttggtagaatttgacgctatggttcgttttgactcacttgttgaaatggattactatcgtcacggtggaattttacaaatggttttaagaaataaattagcgcaa

SEQ ID NO: 4308 - protein, 901 aa, Staphylococcus aureus
  MISC_FEATURE (1)..(901): aconitate hydratase
MAANFKEQSKKHFDLNGQSYTYYDLKAVEEQGITKVSNLPYSIRVLLESLLRQEDDFVITDDHIKALSQFGKDGNEGEVPFKPSRVILQDFTGVPAVVDLASLRKAMDDVGGDITKINPEVPVDLVIDHSVQVDSYANPEALERNMKLEFERNYERYQFLNWATKAFDNYNAVPPATGIVHQVNLEYLASVVHVRDVDGEKTAFPDTLVGTDSHTTMINGIGVLGWGVGGIEAEAGMLGQPSYFPIPEVIGVRLVNSLPQGATATDLALRVTQELRKKGVVGKFVEFFGPGVQHLPLADRATIANMAPEYGATCGFFPVDDESLKYMKLTGRSDEHIALVKEYLKQNHMFFDVEKEDPNYTDVIELDLSTVEASLSGPKRPQDLIFLSDMKSSFENSVTAPAGNQGHGLDKSEFDKKAEINFKDGSKATMKTGDIAIAAITSCTNTSNPYVMLGAGLVAKKAVEKGLKVPEYVKTSLAPGSKVVTGYLRDAGLQPYLDDLGFNLVGYGCTTCIGNSGPLLPEIEKAIADEDLLVTSVLSGNRNFEGRIHPLVKANYLASPQLVVAYALAGTVDIDLQNEPIGKGNDGEDVYLKDIWPSIKEVSDTVDSVVTPELFIEEYNNVYNNNELWNEIDVTDQPLYDFDPNSTYIQNPSFFQGLSKEPGTIVPLNGLRVMGKFGDSVTTDHISPAGAIGKDTPAGKYLQDHQVPIREFNSYGSRRGNHEVMVRGTFANIRIKNQLAPGTEGGFTTYWPTNEVMPIFDAAMKYKEDGTGLVVLAGNDYGMGSSRDWAAKGTNLLGVKTVIAQSYERIHRSNLVMMGVLPLEFKKGESADSLGLDGTEEISVNIDENVQPHDYVKVTAKKQDGDLVEFDAMVRFDSLVEMDYYRHGGILQMVLRNKLAQ

SEQ ID NO: 4309 - DNA, 1644 bp, Staphylococcus aureus
atgaattcttcttcaccagagaatccaaatggaaagaagtattcaccagtcttcatctatagtgcaattgttgttgctatagtcgtattacttggtgcatttttacctgaacaattcaactatgttaccaataatattaaaatgtggattacagaaaagttaggttggtattatcttattcttactacgattatcgtgttcttctgtatattccttatttttagtcctattggaaaacttaaactaggtaaaccaaatgacaaacctgagtttaatacaatttcatggtttgctatgttgtttagtgctggtatggggataggtttggtgttttatggtgcagctgaaccgatggcgcactttgctacgccacctacagcagatcccaaaactactgaagcttatactgaagctctacgttcaacatttttccattggggattccatgcttgggctgtttatggtgttgttgcgttagcgttggcatattcgcaattccgtaaaggtgaaccaggtttattatctagaactttacgtcctcttttaggtgataaagtagaaggtcctattgggatttttattgacgttttatctgtatttgcgacaatcgttggggtagccgtttcgttaggtatgggtgctctacaaattaatggtggtttacattacttgttcaatgttccaaacaatacgtttgtacaagcgattatcatcattgttgttactatcttatttatagcaagtgcatggtctggattaagtaaaggtattcaatacttaagtaacttgaacattggtttaggtactattttaatggtagctgctttaattgttggaccaactgttcttattttaaatatgttaactagctctacgggtagtttactaaacacattcttgtttaatagttttgatacagcagctttaaatcctcaaaaacgtgaatggatgtcttcatggacactttattactggggttggtggttaagttggagtccattcgttggagtgtttattgcacgagtttcaaaaggacgttcaattagagagttcatttctggtgtcttgctagttccagcaattgttagttttgtttggtttagtgtctttggtgtattaggcatcgagacaggtaagaaacacaaagaaatttttgatatgactcctgaaacacagctatttggagtgtttaatcatgtgccatttggcattgttttatcgttgattgcattattattaattgcatcattctttattacatctgctgactcagcaacatttgtattaggaatgcaaacaacatttggttcattaaatccatctagtatggtaaaagttgtttggggaatttcacaggccttaatagcatttgtacttttattagctggtggcggtaacggcgctgaagctttaaatgcgattcaaagtgctgcaattataagtgcattcccattctcctttgtcgtcatactcatgatggtaagtttctacaaggatgcgaaccaggaacgtaaattcctaggtttaacattgactccgaataaacatcgcttacaagaatatatcaagagtcaacaagaagattatgaatctgacattcttgaaaagcgtcagtcacgtagaaatatagagaaaaaagataac

SEQ ID NO: 4310 - protein, 548 aa, Staphylococcus aureus
  MISC_FEATURE (1)..(548): glycine betaine transporter
MNSSSPENPNGKKYSPVFIYSAIVVAIVVLLGAFLPEQFNYVTNNIKMWITEKLGWYYLILTTIIVFFCIFLIFSPIGKLKLGKPNDKPEFNTISWFAMLFSAGMGIGLVFYGAAEPMAHFATPPTADPKTTEAYTEALRSTFFHWGFHAWAVYGVVALALAYSQFRKGEPGLLSRTLRPLLGDKVEGPIGIFIDVLSVFATIVGVAVSLGMGALQINGGLHYLFNVPNNTFVQAIIIIVVTILFIASAWSGLSKGIQYLSNLNIGLGTILMVAALIVGPTVLILNMLTSSTGSLLNTFLFNSFDTAALNPQKREWMSSWTLYYWGWWLSWSPFVGVFIARVSKGRSIREFISGVLLVPAIVSFVWFSVFGVLGIETGKKHKEIFDMTPETQLFGVFNHVPFGIVLSLIALLLIASFFITSADSATFVLGMQTTFGSLNPSSMVKVVWGISQALIAFVLLLAGGGNGAEALNAIQSAAIISAFPFSFVVILMMVSFYKDANQERKFLGLTLTPNKHRLQEYIKSQQEDYESDILEKRQSRRNIEKKDN

SEQ ID NO: 4311 - DNA, 183 bp, Staphylococcus aureus
atgacaacagcattaattggtgtaattgtattaatcttactaattattagctttgtgccaaactaccgtgctatgaaatcagcaaaagaacaaggaagtaatgcaacaagagctacaattatggtaggcatagatattatcttaattgtacttatcatcgtgacgttattattaaaatatatg

SEQ ID NO: 4312 - protein, 61 aa, Staphylococcus aureus
  MISC_FEATURE (1)..(61): hypothetical protein
MTTALIGVIVLILLIISFVPNYRAMKSAKEQGSNATRATIMVGIDIILIVLIIVTLLLKYM

SEQ ID NO: 4313 - DNA, 189 bp, Staphylococcus aureus
atgatgggttacattatattgttttttctagctggtccagtaattttaggcgttggaaatttggtgattggtcctatatttaacaaacagacaccatttcgcgtgcaagtaagatcttttgttgttggttcaatgatttacttaatactcgcaacaattggctattttttactattacaaggtaaactt

SEQ ID NO: 4314 - protein, 63 aa, Staphylococcus aureus
  MISC_FEATURE (1)..(63): hypothetical protein
MMGYIILFFLAGPVILGVGNLVIGPIFNKQTPFRVQVRSFVVGSMIYLILATIGYFLLLQGKL

SEQ ID NO: 4315 - DNA, 633 bp, Staphylococcus aureus
atgtatagagcagttatatttgatttcgatggaacaataatagatacggaacaacatttatttaatgttattaataaacatttagagatgcataatgccgatcctataagcattgatttttatcgttcttctattggaggagcagctacagatttgcatgaccatttaattaaagcgattggttcggaaaataaagataaactttatgaagaacatcatcttactagtacaacattaccgatgattgatacgattaaatcattgatggcatttttaaagcaacgtcacattcctatggcaattgccacaagtagtgtgaaagcggaaataatgcccacctttaaagcattaggtctagacgattatatagaggtagttgttggtagagaagatgttgaacaagttaaacctgaccctgaattatatttatctgcagtacaacaattaaattatatgccgacacaatgtttggctattgaagattctgtaaatggtgcaacagccgcgattgcagctggattagatgttattgttaatacgaataaaatgacaagcgcacaggacttttctaatgtagattatgtagcaaaagatattgattacgatcaaattgtagcgcgtttctttacgaaa

SEQ ID NO: 4316 - protein, 211 aa, Staphylococcus aureus
  MISC_FEATURE (1)..(211): hypothetical protein
MYRAVIFDFDGTIIDTEQHLFNVINKHLEMHNADPISIDFYRSSIGGAATDLHDHLIKAIGSENKDKLYEEHHLTSTTLPMIDTIKSLMAFLKQRHIPMAIATSSVKAEIMPTFKALGLDDYIEVVVGREDVEQVKPDPELYLSAVQQLNYMPTQCLAIEDSVNGATAAIAAGLDVIVNTNKMTSAQDFSNVDYVAKDIDYDQIVARFFTK

SEQ ID NO: 4317 - DNA, 1284 bp, Staphylococcus aureus
gtgaaattatcacagtcactagacccgagcacattatttcatctcactgacaatgaggcaggagatcgcttttatatgcgtttgaatgataatcgaacgtcatattttggctacaaagcaattcaattattcaaaaataattctaaaaataaacaatctatttttaaagactgggaaaaattaaaacataacatcacatttatacatccgcaatctgagaaacatcatcttcgagttgttggagggttccaattttcaagtcataaatcagatgatgaatggcgagagtttggactaaatcattttgtattacctgaagttttaatttcaactgataataatgggacatttttaacttatacagttaaaagggaaagttttactgttgaggcattgaacgatttaatggatttgttcaacaatatatcggacatagatgtggacgagcaaattggggaaattactagaaatgaagatatttataaagatgactggcgtcaacttgtagtagaagctatagaatctattaataatgaagaaaaaattgtactagcacgtagacggttaataaagttcgataaagatatcagtattccatatattctaaagcaagcatattctaaagaaaaaaacagttatatattcttgttagaatcacaagattctatattcttttcacaaacacctgaacaattaataaaggtcaataataaaatactatcgactaaagctgtagcaggtacaattaaacgttcacaagatgaggacgaagatacaaaaaatgttgaagcatttttaaaagataataaaaacttaatcgaacatcgatttgttgttgacagtattttacatgatattaaaccttatatcactgaattacattatgataagacgcctaaaattctaaaaaatgatcatttatatcacttgtacactgaaataaaggcgccactgaaggatgattcgtatattagtttaattgataatttacatccaacacctgctttaggtggctatccaaaagaatttgcaatggattttattgagcagaaagaatttggtacgcgaggattatatggtgcaccggttggctatatagatatatacgatgattgtgaatttattgttgcaattcgttcgatgcttattaagaaagcacaagcaactttatttgctgggtgtggcattgttaaagattctgatccagatagtgaattggcagaaacgaaccttaagttcacacctatgatgaatgcattaggagtcgatatgaatgggaaatca

SEQ ID NO: 4318 - protein, 428 aa, Staphylococcus aureus
  MISC_FEATURE (1)..(428): hypothetical protein
VKLSQSLDPSTLFHLTDNEAGDRFYMRLNDNRTSYFGYKAIQLFKNNSKNKQSIFKDWEKLKHNITFIHPQSEKHHLRVVGGFQFSSHKSDDEWREFGLNHFVLPEVLISTDNNGTFLTYTVKRESFTVEALNDLMDLFNNISDIDVDEQIGEITRNEDIYKDDWRQLVVEAIESINNEEKIVLARRRLIKFDKDISIPYILKQAYSKEKNSYIFLLESQDSIFFSQTPEQLIKVNNKILSTKAVAGTIKRSQDEDEDTKNVEAFLKDNKNLIEHRFVVDSILHDIKPYITELHYDKTPKILKNDHLYHLYTEIKAPLKDDSYISLIDNLHPTPALGGYPKEFAMDFIEQKEFGTRGLYGAPVGYIDIYDDCEFIVAIRSMLIKKAQATLFAGCGIVKDSDPDSELAETNLKFTPMMNALGVDMNGKS

SEQ ID NO: 4319 - DNA, 957 bp, Staphylococcus aureus
atggtaatatttttcaatattatcgacgaggatgtgttaacaatgtttcaaaaattgagtatatttgccacgaagagttttttggtatggatgttagtagcagctgttattggatttattttcccacaacatgttgcgacattaggtaaatgggtaccttatttacttggtattgttatgttaggtatgggattaacaattacacctaatgatttcaaaatggtctttaaagcacctagagcagtaattattggtgtctgtctacaattcagtattatgcccacattagcatttataattgcaaagtcttttcatttaccacctgatattgctgttggcgtaatattagttggatgttgtccgggtgggacatcaagtaatgtaatgagttatttagccaaagctaacgtagcactttctgtttctattacgacggtctctacgttgctagcgccattcgttacacctgcgttaatatatctatttgcaaatgaatggttggaagtatctttcgtgagtatgttgtggtcagttgttcaagttgtattaattccaattgctttaggtattgttttgcaaattattaatcgtaaaattgctgaaaaagcttctacagctttgccaattatatcagttgttgctatttcattaattttagcaatagttgtaggtggcagtaagcaccaaatcttaactacaggattattaatatttttagtagttattttacataacgtattagggtatacgattggatattggttagctcgtcttttaaaattagatcgacaagatcaaaaagcagtcagtattgaagttggaatgcagaactctggtttagctgtgtcattagcagcattgcattttaatccaattgcagcagtaccaggcgcagtgtttagtttcattcataatataacagggcctattttagcaaagtattggtcaaaaaagtta

SEQ ID NO: 4320 - protein, 319 aa, Staphylococcus aureus
  MISC_FEATURE (1)..(319): hypothetical protein
MVIFFNIIDEDVLTMFQKLSIFATKSFLVWMLVAAVIGFIFPQHVATLGKWVPYLLGIVMLGMGLTITPNDFKMVFKAPRAVIIGVCLQFSIMPTLAFIIAKSFHLPPDIAVGVILVGCCPGGTSSNVMSYLAKANVALSVSITTVSTLLAPFVTPALIYLFANEWLEVSFVSMLWSVVQVVLIPIALGIVLQIINRKIAEKASTALPIISVVAISLILAIVVGGSKHQILTTGLLIFLVVILHNVLGYTIGYWLARLLKLDRQDQKAVSIEVGMQNSGLAVSLAALHFNPIAAVPGAVFSFIHNITGPILAKYWSKKL

SEQ ID NO: 4321 - DNA, 552 bp, Staphylococcus aureus
atgtattcctcgggaggtcctcacatgttaattgataaattcgaaacatacatcatcaacatcgccggtttaaatgaccgtactactagaaaaaaattaagtaagttatgcaaaagtgtacaattttgtgatgcgttgcaattctcaataaacaaacagtttaatcagtatgtattagaaattagcttaccaaagcaacaacttccatacttcatttcatttttaagttttcatcagtatagtattttccaagtactttcaccaaagaaaataaatgaattacttgattctgataatttatatcaatctgcaaagcgtttcgatatcaatattgatggcttgcaagatgctttcattaaagacaaagtcatcgatattatgaatatgttccaaaatcacactgatatcacttatacgttgaataagtctcatgcacatattatatgtacgccagaaatatttgctaaattgttacatacgattgcaactagaaatatcgacattctatctgccaattatagatcgtcatctatgagcaaagctcgtatatca

SEQ ID NO: 4322 - protein, 184 aa, Staphylococcus aureus
  MISC_FEATURE (1)..(184): hypothetical protein
MYSSGGPHMLIDKFETYIINIAGLNDRTTRKKLSKLCKSVQFCDALQFSINKQFNQYVLEISLPKQQLPYFISFLSFHQYSIFQVLSPKKINELLDSDNLYQSAKRFDINIDGLQDAFIKDKVIDIMNMFQNHTDITYTLNKSHAHIICTPEIFAKLLHTIATRNIDILSANYRSSSMSKARIS

SEQ ID NO: 4323 - DNA, 1602 bp, Staphylococcus aureus
atgaatgcgataaagcgtttcggtagtgcaatgattgtaccggtattaatgttcgctttctttgggatagtgcttggctttgcgacattatttaaaaatcctacaatcatggggagtttagcagatcaacatacgttttggtttaaattttggtcagtaatagaatctggtggctgggttatttttacgcatatggaagttgtatttgttgtaggtctaccactttctttagctaaaaaagcaccaggtcatgcagcacttgcagcattgatgggttacttaatgtttaatacatttataaatgccattttaacacaatggccacatacgtttggcgctaatttagaaaaaggcgttgaaaatgtacctggtttaaaatcaattgcaggtattgccacattggatacgaatattctaggtggtattattatttcagctattattacttggattcacaatagatactatagtaaacgattaccagaaatggttggtgtattccaaggtttaacatttgtagttacgatttcattttttgtgatgttaccattagcagcaattacttgtgttatttggccaactgttcagcacggtattggttcaatgcaacactttatcattgcttcaggctatatcggtgtatggttgtatcacttcttagaacgtgtattaataccaacaggattacatcactttatttatgcaccaattgaagttggaccagtagtagtcaatcacggcttgaaagctgaatggttacaacatttaaatgagtttgctaagagtactaagccattaaaagagcaattcccttatggctttatgcttcaaggaaatgggaaagtatttggatgtttaggtattgctttagcaatgtatgctacgacacctaaagaaaatcgtaaaaaggtggcggcactacttattcctgccacattaacagcagtcgttgtaggtattactgagccattagagtttacattcttattcatcgcaccatacttatttgttttacacgcagttttagcagcatcaatggatactttaatgtacgcatttggtgttgtaggtaacatgggtggtggcttgttagactttatttcaacaaactggttgccattaggtaaagaacattggggtacttatgttgcacaagttattatcggtctgatatttgtagcgatttacttcttcttattcagattcttaattttgaaatttgatattccattacctggacgtaagaaaacagaagaggaagttaaattattttctaagcaagattacaaaaataaaaaaggtgatagcgtagattctaaacgtgcttcatctggtaatgaatacgaagacaaagctgcatattacctcgacggtttaggcggcaaagaaaatatcaaagatgttactaactgtacaacaagattacgcttaactgtttatgatgaaagtaaagttgcagatacggaatatttcacgcatcaacaaatggcacacggattagtaaagagtggtaagagtatccaagttgtagtaggtatgacagtaccacaagttcgtgaagcatttgaacaaatggttgaggatcaatcgtccgaagataaa

SEQ ID NO: 4324 - protein, 534 aa, Staphylococcus aureus
  MISC_FEATURE (1)..(534): PTS system, arbutin-like
MNAIKRFGSAMIVPVLMFAFFGIVLGFATLFKNPTIMGSLADQHTFWFKFWSVIESGGWVIFTHMEVVFVVGLPLSLAKKAPGHAALAALMGYLMFNTFINAILTQWPHTFGANLEKGVENVPGLKSIAGIATLDTNILGGIIISAIITWIHNRYYSKRLPEMVGVFQGLTFVVTISFFVMLPLAAITCVIWPTVQHGIGSMQHFIIASGYIGVWLYHFLERVLIPTGLHHFIYAPIEVGPVVVNHGLKAEWLQHLNEFAKSTKPLKEQFPYGFMLQGNGKVFGCLGIALAMYATTPKENRKKVAALLIPATLTAVVVGITEPLEFTFLFIAPYLFVLHAVLAASMDTLMYAFGVVGNMGGGLLDFISTNWLPLGKEHWGTYVAQVIIGLIFVAIYFFLFRFLILKFDIPLPGRKKTEEEVKLFSKQDYKNKKGDSVDSKRASSGNEYEDKAAYYLDGLGGKENIKDVTNCTTRLRLTVYDESKVADTEYFTHQQMAHGLVKSGKSIQVVVGMTVPQVREAFEQMVEDQSSEDK

SEQ ID NO: 4325 - DNA, 768 bp, Staphylococcus aureus
ttgaatatgtttttagatgaacacattaatcgaaactttgataaacttaatgataatgatttacatatcgctcactttatcaatacacatatagatgaatgtaaaaatatgaaaatacaagatttagcgcaattcacacatgcctcgaatgcaaccattcacagatttacacgcaaattaggttttgacggttatagtgattttaaatcgtaccttaaatttgaaagtaataagacacaccaattaccttctaactctatcgatagtttcaaacaagaaatcgatagtacattcagttatttagaacgcgttgattaccagcttcttactaaaaaaatgcatacagcttcaacaatatatttgtatggtacagggcgtgcacagttaaacgttgcttcagaggcacagcgtatattgttaacgttacataatcatgtcattgtacttcatgatgaacatgaacttaaaatgattttgaacaagagtgaacctaatgatttattctttattatttcattatcaggtgaaacacatgaattattagaagtaacaaacttgcttcaacttagacaaaaatactttatttctgttactacaatgaaagataatacccttgctcaaaaagcaaattacaacgtctatgtatccagtaacacattctacttaactgatggtacagactattctagcttcatcagttatcatatattctttgaaacacttgtaagaaaatataatgagtatttactacataatgatatttcaaat

SEQ ID NO: 4326 - protein, 256 aa, Staphylococcus aureus
  MISC_FEATURE (1)..(256): hypothetical protein
LNMFLDEHINRNFDKLNDNDLHIAHFINTHIDECKNMKIQDLAQFTHASNATIHRFTRKLGFDGYSDFKSYLKFESNKTHQLPSNSIDSFKQEIDSTFSYLERVDYQLLTKKMHTASTIYLYGTGRAQLNVASEAQRILLTLHNHVIVLHDEHELKMILNKSEPNDLFFIISLSGETHELLEVTNLLQLRQKYFISVTTMKDNTLAQKANYNVYVSSNTFYLTDGTDYSSFISYHIFFETLVRKYNEYLLHNDISN

SEQ ID NO: 4327 - DNA, 504 bp, Staphylococcus aureus
gtggcaaaatttaatgtagagaatgaacatgtcgaagttgaaattgaaaagctttataaattttctccagagttagtatacgaagcttggacaaagaaagatttgttgaaacaatggtttatgacatcagccagaacgaataaagagattgaagcggacgttaaagaaggcggtaaatatcgtattgtagatcaacaacgtaatggcaaagtaaatgtgattgaaggcatttatgaatctttagttatggatgaatacgttaagatgactatcggtatgcctggactaagtgaaacgcaagatgtcattgaggtagaattttttgaacgtgaaacaggtggcacccaaatgctattttattatcgttcattagttgaaaaagaaagacgatttactaatttagaatacaagcaaaagaaaaaagaatatcatgatgccatggtgcatggtttcgaattgatgtttgataagatgtaccacgttatcgaaacatcaacacaacaa

SEQ ID NO: 4328 - protein, 168 aa, Staphylococcus aureus
  MISC_FEATURE (1)..(168): hypothetical protein
VAKFNVENEHVEVEIEKLYKFSPELVYEAWTKKDLLKQWFMTSARTNKEIEADVKEGGKYRIVDQQRNGKVNVIEGIYESLVMDEYVKMTIGMPGLSETQDVIEVEFFERETGGTQMLFYYRSLVEKERRFTNLEYKQKKKEYHDAMVHGFELMFDKMYHVIETSTQQ

SEQ ID NO: 4329 - DNA, 1377 bp, Staphylococcus aureus
atgaaaacctctttcttcatcgtttgtgagaaagaggtatttttaattggaaagcaggtaaaaaggatggaagtacataaaaagagcaatgcttgggcattattccccttgttattatttgtggcgttgtttttaggcgtaggtattatcacaggtgattttacttcaatgccattaaatgttgcaattacgataacggtaattgtggcgttattaatgaatcgaaaagaatcatttgctaaaaaagttgaggtcttcacgaaaggtgcaggccattcaaacattgttttaatgatgttgatttttattttagcaggtgcattttcaaatacagctgaaaaaatgggtggcgtaaagtcgacagttaatttaggactatcattaatcccagaaaatttaattattgtaggattgtttgtgatttgtatgtttgtttctatatctatggggacgtctgtaggaactgttgctgcaatagcacctgttggttacggatttgcacaagcgacagatgtaccaactgcgctagcaatggctacagttgttggaggtgcaatgttcggcgataatctatcaatgatttcagatacaacaattgctgcggttagaacacaacatacgaaaatgaaagataaattcagagtaaactttaaaattgtattgccaggtgctattttaacgattattattctgtatttcttaacgaatggcatttctttaaatcatgctaaaaactatgattataatctaattaaagttgtaccgtatatcttagtattggtattagcattattaggtgtaaatgtcattatcgtattgattggcggaacattattagccggaatcattggtctcatagatggttcattcggttggatggggctactagatgcagtgtccaaaggtattataagcatggaagatattgctatgattgcgttgctaattggtggtttagtcggtattattcaacacaatggtggtattgaatggttgttgcaatttgttcgctctaaagtgaaatcaaagcgtggcgcagaattaggaattgctagtttggtaagtgtcgcagatattgccacggcaaacaacaccatctctattattatgtcaggtcctttagctaaaaatattgcagatgaatatgatgtagattcaaggaaatcagcaagtattcttgatatatttggaggctgcttccaaggtttattaccatatagcccgcaagtcatttcagcggctggtgtagctggtatttcaccgttaatgttattcccatacagcatttatcctatattattaggtgtatgcggacttattgcgattttatttaattttccaaagctaaaaaagaacactagtcaagaaatgaaacat

SEQ ID NO: 4330 - protein, 459 aa, Staphylococcus aureus
  MISC_FEATURE (1)..(459): hypothetical protein
MKTSFFIVCEKEVFLIGKQVKRMEVHKKSNAWALFPLLLFVALFLGVGIITGDFTSMPLNVAITITVIVALLMNRKESFAKKVEVFTKGAGHSNIVLMMLIFILAGAFSNTAEKMGGVKSTVNLGLSLIPENLIIVGLFVICMFVSISMGTSVGTVAAIAPVGYGFAQATDVPTALAMATVVGGAMFGDNLSMISDTTIAAVRTQHTKMKDKFRVNFKIVLPGAILTIIILYFLTNGISLNHAKNYDYNLIKVVPYILVLVLALLGVNVIIVLIGGTLLAGIIGLIDGSFGWMGLLDAVSKGIISMEDIAMIALLIGGLVGIIQHNGGIEWLLQFVRSKVKSKRGAELGIASLVSVADIATANNTISIIMSGPLAKNIADEYDVDSRKSASILDIFGGCFQGLLPYSPQVISAAGVAGISPLMLFPYSIYPILLGVCGLIAILFNFPKLKKNTSQEMKH

SEQ ID NO: 4331 - DNA, 567 bp, Staphylococcus aureus
atggcattaatagtatctagagctatattatttttgattttagcattagcttttggaatagcgactgtttttcctgaacaaaaattaccattatatatagtattcacattatttgtagcagttgcgatcgtttcgaatgtatggtttacacatcaaaacgttaaaaagcatatcattaagtttaacaaatacgtcgcatactttttatcctttgtctcagggttactttacattggatttgtaatttatacattaactatagggagctatgatgttttaccaattattatatttgcaataagtatcgtattggttcaaatattagaaaatatactgggaatcagtataaaaaatacgcgtctatcaaacaaacagttgaaagtcatctccaagcaacgtgttcagcaatttaaagtcatatcattaatattagtaagtgtgtctatcgtgttcatttttattgcattaatgcttaaatggtggcttttacttgttattagcattattgttttgattattattacagtagcaatgattgtttatgaaaaatattatacgactcctgat

SEQ ID NO: 4332 - protein, 189 aa, Staphylococcus aureus
  MISC_FEATURE (1)..(189): hypothetical protein
MALIVSRAILFLILALAFGIATVFPEQKLPLYIVFTLFVAVAIVSNVWFTHQNVKKHIIKFNKYVAYFLSFVSGLLYIGFVIYTLTIGSYDVLPIIIFAISIVLVQILENILGISIKNTRLSNKQLKVISKQRVQQFKVISLILVSVSIVFIFIALMLKWWLLLVISIIVLIIITVAMIVYEKYYTTPD

SEQ ID NO: 4333 - DNA, 879 bp, Staphylococcus aureus
atggcagctcaagatcctagaacaaaatttaaaacaacggattatgaaaaacaagaacaagaggtaccgggtttacaatctgaaatgacgccagcacccgattgtggcgaaacgtcttaccaaggtcatcaacgcttacaaggctataaaatattagtcacaggtggtgactcagcaatagggcgtgcagcagcaattgcgtatgctaaagaaggtgcagatgtagcgattaactatcttccgagtgaagaacaagatgcacaagaagtacgccaagtgattgaagaaagtggtcaaaaggcagtgttaattcctggtgatataagagatgaacagttcaactatgaccttgttgaacaagcatatcaacaattaggtggcttagataatgttactttagttgctggacatcaacagtatcatgatgatattcatggatttacaactgaggcatttacagaaacatttgaaacgaatgtctatccgctattttggacagttcaaaaagcattggaatatttaaaaccgggtgcgtcaattacaacgacatcatctgtacaaggttataatcctagtcctattcttcatgattatgccgcttcaaaagcagcaattatttcattaactaaaagtttttcagaagaattaggaccaaaaggaattagagtgaactgtgtagcgcctggtccattctggtcaccattacaaatttctggtggacaacctcaaagtaaaatcccaacatttggtcaaaaaacacctttaggtcgtgcaggtcaacctgttgagttatgtggaacttatgtgctattagcgtcagaagaatcaagttatacaaccggacaagtgttcggtgttagcggtggagtgcaaatagat

SEQ ID NO: 4334 - protein, 293 aa, Staphylococcus aureus
  MISC_FEATURE (1)..(293): hypothetical protein
MAAQDPRTKFKTTDYEKQEQEVPGLQSEMTPAPDCGETSYQGHQRLQGYKILVTGGDSAIGRAAAIAYAKEGADVAINYLPSEEQDAQEVRQVIEESGQKAVLIPGDIRDEQFNYDLVEQAYQQLGGLDNVTLVAGHQQYHDDIHGFTTEAFTETFETNVYPLFWTVQKALEYLKPGASITTTSSVQGYNPSPILHDYAASKAAIISLTKSFSEELGPKGIRVNCVAPGPFWSPLQISGGQPQSKIPTFGQKTPLGRAGQPVELCGTYVLLASEESSYTTGQVFGVSGGVQID

SEQ ID NO: 4335 - DNA, 1671 bp, Staphylococcus aureus
atgggaaatcataaagcagctttaacgaagcaagtttttacatttgcatctgagttatatgcgtacggcgtaagggaagtagttatcagtccgggatcacgctcaacgccacttgcacttgcatttgaagcacatccaaatattaaaacatggatacaccccgatgagcgaagtgcagcgttttttgcagttgggttaattaaaggcagtgaaagacctgtcgctatattatgtacgtcaggtacagcagcagcgaattatacgcctgcaattgctgaaagccaaattagtagaattcctttaatcgttttaacaagtgaccgtccgcatgaattaagaagtgtaggcgcaccacaagcgattaatcaagtaaatatgtttaataattatgtaagttatgagttcgatatgcctattgcggatgatagtaaagagaccattgatgcaatttactatcaaatgcaaattgctagtcaatatttatatggaccacataaagggccaattcattttaacttgccatttagagatccgttaacacctgatttgaatgcaacagaattgttaacttctgagatgaagattttaccgcactatcaaaaaagtatagatgcatcggcattaagacacattttaaataagaaaaaaggtttaattattgtaggggatatgcagcaccaagaagttgatcaaatactaacgtattcaacgatatatgatttgcctattttagctgatcctttaagtcatttaagaaaatttgatcatccgaatgttatctgtacatatgatttgctgtttagaagcggcttagacttaaatgtggatttcgtaattcgtgttgggaaaccagtgatttctaaaaagttaaatcaatggttaaagaaaactgatgcatttcaaatattagtgcaaaacaatgataagattgatgtctttccgatagcgccagatatttcatatgagatttctgcgaatgatttctttaggtcattaatggaagacacgacagttaatcgcgtaagttggttagaaaaatggcaatgcttagagaaaaaagggcgtaaagaaattaaatgttatttggaacaagctacagatgagagtgcattcgttggtgaattgattaagaaaacatctgaaaaagatgcattatttattagtaatagtatgcctatcagagatgtagataacttgttattgaataaaaatatagatgtctatgcgaatcgtggtgcgaatggtattgatggtatcgtttcaactgcactgggtatggctgtgcataaacgaataacattattgataggtgatttatcattttatcatgatatgaatggactattaatgtcaaaattaaataatattcagatgaatattgtattattgaacaacgatggtggcggtattttttcatatttaccacaaaaagaaagtgcaactgactattttgaacggttgtttggcacaccgacgggattggatttcgagtatacagctaagttatatcaattcgattttaaacgttttaacagtgtttcagaatttaaaaatgccacattgttatctgaaacttcgacgatttatgaattgataacgaatcgcgaagataactttaaacagcatcaaattttataccagaaattgagtgaaatgattcatgacacatta

SEQ ID NO: 4336 - protein, 557 aa, Staphylococcus aureus
  MISC_FEATURE (1)..(557): menaquinone biosynthesis
MGNHKAALTKQVFTFASELYAYGVREVVISPGSRSTPLALAFEAHPNIKTWIHPDERSAAFFAVGLIKGSERPVAILCTSGTAAANYTPAIAESQISRIPLIVLTSDRPHELRSVGAPQAINQVNMFNNYVSYEFDMPIADDSKETIDAIYYQMQIASQYLYGPHKGPIHFNLPFRDPLTPDLNATELLTSEMKILPHYQKSIDASALRHILNKKKGLIIVGDMQHQEVDQILTYSTIYDLPILADPLSHLRKFDHPNVICTYDLLFRSGLDLNVDFVIRVGKPVISKKLNQWLKKTDAFQILVQNNDKIDVFPIAPDISYEISANDFFRSLMEDTTVNRVSWLEKWQCLEKKGRKEIKCYLEQATDESAFVGELIKKTSEKDALFISNSMPIRDVDNLLLNKNIDVYANRGANGIDGIVSTALGMAVHKRITLLIGDLSFYHDMNGLLMSKLNNIQMNIVLLNNDGGGIFSYLPQKESATDYFERLFGTPTGLDFEYTAKLYQFDFKRFNSVSEFKNATLLSETSTIYELITNREDNFKQHQILYQKLSEMIHDTL

SEQ ID NO: 4337 - DNA, 1119 bp, Staphylococcus aureus
atgggattaaaagatcaagctgttacctggagaaggtattttcatcaatttccagaactatccgataaagaatttaagactacacaaaaaattaaagatattttaacagaacatcatattagaatattagacttaccacttgcgactgggcttgttgctgaagtgggacaaggtctgagttgtatagctgttcgggctgacattgatgctttaccgattcaagagcttgttgaacaggattttaaatctgaaaatgaaggtgttatgcatgcgtgtggtcatgatattcacatggctagtattttggctacagctgtaaaattaaaagaaattgagggcactcttactgggcgtgttaaattcatttttcaatcagcagaagaactaggacatggcgcttttaaaattattgaaacacatgcattaaaagatgtacaagcagtattgggttttcataatgacccatcgcgttcggtaggtacatttgcaatcaaaacaggggcaattacatcagcagtagatcgttttgagtttcatattaaaggcgtgggtggtcatgctgcaaagccagaacaatgcaacgatccagttattgtgttggcgcaattgattaatagtattcaatccatagttagtagaaatctatctgcgtttgatgaagcggtagtaacaattggacaaatatcatgtggtaatacttggaatgtcattgctgatcatgcgtatgtacaaggcacagtgcgtagttttgatcctgtggtacgaaagcttgtagaaacacgattacaagatattgcggacggattggctcaagcatataatatgaaaattaatttaaattatacgcatttacctggcgctgtgatgaatgatgaggcattgacgcataaagcaattgcagtagcccaacatgttggatataaggtgggaatgatggaacagccgcttacgattggagaagatttttcaggttatagtcaacattttccaagtgtatttgcgttaattggttctcatagtgaatatgatttacatcatcctcaatataaaccggatgaaaggattctggaaaaagtacctgagtattttgttgaatttgtaaagagactattgcatgaa

SEQ ID NO: 4338 - protein, 373 aa, Staphylococcus aureus
  MISC_FEATURE (1)..(373): hypothetical protein
MGLKDQAVTWRRYFHQFPELSDKEFKTTQKIKDILTEHHIRILDLPLATGLVAEVGQGLSCIAVRADIDALPIQELVEQDFKSENEGVMHACGHDIHMASILATAVKLKEIEGTLTGRVKFIFQSAEELGHGAFKIIETHALKDVQAVLGFHNDPSRSVGTFAIKTGAITSAVDRFEFHIKGVGGHAAKPEQCNDPVIVLAQLINSIQSIVSRNLSAFDEAVVTIGQISCGNTWNVIADHAYVQGTVRSFDPVVRKLVETRLQDIADGLAQAYNMKINLNYTHLPGAVMNDEALTHKAIAVAQHVGYKVGMMEQPLTIGEDFSGYSQHFPSVFALIGSHSEYDLHHPQYKPDERILEKVPEYFVEFVKRLLHE

SEQ ID NO: 4339 - DNA, 1236 bp, Staphylococcus aureus
atgaatgatttaataattaatcatatagcagaattaattttaccgagatcaacagataaacctttgaagggtaaggaattagatgaattaaatgttgtgaaaaatggtacagttgtcattaaagatggcaaaattgtatatgctggaacacatacagatgactacgatgcgactgagacgattgatgctagtgggaaggtagtgtccccagcattagtagatgcacatacccatttaacatttggtggatctcgagaacatgagatgtcattaaaacgtcaaggtaagtcttaccttgaaatattagaaatgggtggtggcatattatctaccgttaatgctactagagaaacatccgaagatgacttgtttaaaaaagcagagcatgatttgcttactatgattaaacacggcgtgcttgcagttgaaagtaagagtggttatggattagatagagaaaatgaactgaagcaattgaaagtgtctaatcgtttagctgagaaatatgatttagacatgaaacatactttcctagggcctcatgctgtacctaaagaggcaagttcaaatgaggcatttttagaagaaatgattgcgttacttccggaagtaaaacaatatgcagactttgcggatattttctgtgaaacaggtgtatttacaatagaacaatcgcaacattatatgcaaaaagccaaagaagcaggttttaaagtgaaaatacatgcggatgaaattgatccgttaggcggactggaattagcaattgatgaacaagcaatatcagcagaccacttagtagcttctagtgataaaggaaaagaaaagttgcgaaatagtgatactgtagctgtcctcttacctgcaacgacgttctatttaggtaaagaagattatgcagatgcaagaggcatgcttgacaataacggtgcgattgcattagcaactgattataaccctggtagtagtgtcacaaacaacttacaacttgttatggcgattgcagccttgaaattaaagctatcacctaatgaagtttggaatgctgttacggtcaatgctgctaaagcaatagacattaacgcgggtacaattaacacaggtgataaggctaatttagtaatttgggatgcaccaaatcatgaatatattccatatcattttggtatcaatcacgcagaaaaagttattaaagacggtaaggtcatcgtagataacacagtatcttttaaagca

SEQ ID NO: 4340 - protein, 412 aa, Staphylococcus aureus
  MISC_FEATURE (1)..(412): imidazolonepropionase
MNDLIINHIAELILPRSTDKPLKGKELDELNVVKNGTVVIKDGKIVYAGTHTDDYDATETIDASGKVVSPALVDAHTHLTFGGSREHEMSLKRQGKSYLEILEMGGGILSTVNATRETSEDDLFKKAEHDLLTMIKHGVLAVESKSGYGLDRENELKQLKVSNRLAEKYDLDMKHTFLGPHAVPKEASSNEAFLEEMIALLPEVKQYADFADIFCETGVFTIEQSQHYMQKAKEAGFKVKIHADEIDPLGGLELAIDEQAISADHLVASSDKGKEKLRNSDTVAVLLPATTFYLGKEDYADARGMLDNNGAIALATDYNPGSSVTNNLQLVMAIAALKLKLSPNEVWNAVTVNAAKAIDINAGTINTGDKANLVIWDAPNHEYIPYHFGINHAEKVIKDGKVIVDNTVSFKA

SEQ ID NO: 4341 - DNA, 1659 bp, Staphylococcus aureus
atgagaaaaattcaagcaaaaaaaggtttgagtattgagtgtaaaggttgggaacaagaagcagtacttagaatgttatacaacaatttagacccagaagttgctgaaagaccagaagatttagttgtttatggtggtattggaaaagcagcacgtaattgggaagcttttgaagcaatagagaaaacgttacgagaattagaatcagatgagacaatgttagtacaatcaggaaagccagttgctgtatttaaaacacatgaagaagcgccacgtgtattaatttcaaattcagtattagtgcctgaatgggcaaactgggatcattttaatgaattagataaaaaaggtttaatcatgtatggacagatgacagccggtagttggatatatattggttctcaaggtattgtgcaaggtacttatgagacatttgccgagctaggtaatcaacactttaatggagatttagcaggcactgttacactgacagcaggtttaggtggtatgggtggtgcgcaaccgttagcaattactatgaatcatggggtagcaatttgcgtggatgttgatgaaacacgtgttgataagcgaattgatacgaaatactgtgatgttaaaacagctgatttagatgaagcattaaaattagcagaagaggcgaaagaacgtggagaaggattatcaatcgggttagttggaaatgctgtagacatccatcaagcgattctagaaaaaggatttaaaattgacattattactgaccaaacaagtgcacatgatccgctaaatggatatgtgccacaaggatactctgtagaagaagcgaaagtattgcgtgaaaaagatccgaaaaaatatgttgaactgtcacaagcttcaatggcaaagcatgttgaattaatgcttgaattccaaaaacgtggcgctgtagcatttgattatggtaacaatattcgtcaagtagccttcaataacggagtgaaaaatgcttttgacttcccaggctttgtaccagcttacattagaccattattctgtgaaggtaaagggccattccgctttgctgcgttgagtggtgatccaaaagatatcgagcgtgcggatgaagaaatgcgcaaacttttcccagaaaatgaaaagttattaagatggcttgatttagctgaagaaaaaatttcatatcaaggactaccatcacgtattgcttggttaggctatggagaaagagcgaaaatgggcttagctttaaatcgtcttgtacgtgacggtgaaatttcagcaccaattgttattggacgagaccatttagatgctggttcagttgctagtcctaaccgtgaaacagaaagtatgaaagatggtagtgacgcggttggtgattgggctgtattgaatgcactcattaacacagctgcaggtggttcatggatttcattccatcacggtggcggtgttggcatgggatattcacttcatgcgggtatggttgttgtagcagatggatcagagcgtgctgaaagaagattggaacgtgtattgacgactgacccaggtatgggtgttgcccgacatgttgatgctggctatgacatcgctattcaaacagctaaagaaaaaggtattcatattccaatgattgataaagcaggtgataag

SEQ ID NO: 4342 - protein, 553 aa, Staphylococcus aureus
  MISC_FEATURE (1)..(553): urocanate hydratase
MRKIQAKKGLSIECKGWEQEAVLRMLYNNLDPEVAERPEDLVVYGGIGKAARNWEAFEAIEKTLRELESDETMLVQSGKPVAVFKTHEEAPRVLISNSVLVPEWANWDHFNELDKKGLIMYGQMTAGSWIYIGSQGIVQGTYETFAELGNQHFNGDLAGTVTLTAGLGGMGGAQPLAITMNHGVAICVDVDETRVDKRIDTKYCDVKTADLDEALKLAEEAKERGEGLSIGLVGNAVDIHQAILEKGFKIDIITDQTSAHDPLNGYVPQGYSVEEAKVLREKDPKKYVELSQASMAKHVELMLEFQKRGAVAFDYGNNIRQVAFNNGVKNAFDFPGFVPAYIRPLFCEGKGPFRFAALSGDPKDIERADEEMRKLFPENEKLLRWLDLAEEKISYQGLPSRIAWLGYGERAKMGLALNRLVRDGEISAPIVIGRDHLDAGSVASPNRETESMKDGSDAVGDWAVLNALINTAAGGSWISFHHGGGVGMGYSLHAGMVVVADGSERAERRLERVLTTDPGMGVARHVDAGYDIAIQTAKEKGIHIPMIDKAGDK

SEQ ID NO: 4343 - DNA, 882 bp, Staphylococcus aureus
atgaaaattattcagttagaatacttcttggctatcgtgaaatataatagttttactaaagctgcacaatttttacatattagccagccatctttaactgctacgattaaaaaaatggaagcagatttaggttatgacttatttacacgttcaacaaaagacatcaagattaccgaaaaaggaatacagttttatcgttatgcgagcgaattagttcaacaatatcgatccacgatggaaaaaatgtatgatttaagcgttacatcagaaccaaggataaaaattgggactcttgaatctacgaatcaatggattgcgaatttaattcgaaagcaccattccgactaccctgaacagcaatatcgtttatatgaaatacatgataaacatcaatctatagagcaattactgaattttaatattcatttagctataacaaatgaaaaaataacccacgaagatataagatccattcctttatatgaggaatcttacattttattagcacccaaggaaacatttaaaaatcaaaattgggtagatgttgaaaatttgccactcatattaccaaacaaaaattctcaagtgcgcaaacacttagatgactattttaatagaagaaatattcgtccaaatgtcgttgtagaaacagatcgattcgaatcagcagttggatttgttcatctcggcttaggttacgctatcattccgagattttattaccaatcatttcacacgtctaatttagaatataaaaaaattcgtccaaacttaggccgaaaaatttatatcaattaccataaaaaacgcaaacactccgaacaagtacatacattcgtacaacaatgccaagattatttatatggacttttagaggctctt

SEQ ID NO: 4344 - protein, 294 aa, Staphylococcus aureus
  MISC_FEATURE (1)..(294): hypothetical protein
MKIIQLEYFLAIVKYNSFTKAAQFLHISQPSLTATIKKMEADLGYDLFTRSTKDIKITEKGIQFYRYASELVQQYRSTMEKMYDLSVTSEPRIKIGTLESTNQWIANLIRKHHSDYPEQQYRLYEIHDKHQSIEQLLNFNIHLAITNEKITHEDIRSIPLYEESYILLAPKETFKNQNWVDVENLPLILPNKNSQVRKHLDDYFNRRNIRPNVVVETDRFESAVGFVHLGLGYAIIPRFYYQSFHTSNLEYKKIRPNLGRKIYINYHKKRKHSEQVHTFVQQCQDYLYGLLEAL

SEQ ID NO: 4345 - DNA, 426 bp, Staphylococcus aureus
gtgaagcagatgttaaaatctattaatcatatatgcttttcagtcagaaatttaaacgattcaatacatttttatagagatattttacttgggaaattgctattgactggtaaaaaaactgcttattttgagcttgcaggcctatggattgctttaaatgaagaaaaagatataccacgtaatgaaattcacttttcatatacacatatagctttcactatagatgacagcgaatttaaatattggcatcagaggttaaaagataataacgtgaatattttagaaggaagagttagagatattagagatagacaatcaatttactttaccgaccctgatggtcataagctagaattacatactggcacacttgagaacagattaaattattataaagaggctaaaccacatatgacattttacaaa

SEQ ID NO: 4346 - protein, 142 aa, Staphylococcus aureus
  MISC_FEATURE (1)..(142): fosfomycin resistance
VKQMLKSINHICFSVRNLNDSIHFYRDILLGKLLLTGKKTAYFELAGLWIALNEEKDIPRNEIHFSYTHIAFTIDDSEFKYWHQRLKDNNVNILEGRVRDIRDRQSIYFTDPDGHKLELHTGTLENRLNYYKEAKPHMTFYK

SEQ ID NO: 4347 - DNA, 933 bp, Staphylococcus aureus
gtgtacaagcaaggtgaaccaaatttatggactggaaggttagatagtgaaacagacccgaaaaaatttagacattttcaaacagtaacatttgaagatttgtctaagctggaaaagagtagtatgccatcaggggtcggtatattaggctatgctgttgacaaaggtgttgctttaaacaaggggcgcattggtgcaaaagaaggaccagatgcgattaaacaagcatttgcaggtttgccggatttgaatcaatgtgaaactttagtcgattacggaaatgtttatcatgatcatgaggaattaattgatactcaaaaagaatttgctatgcttgcagcgaagtcaattgctaatcatagacaaacatttttattaggtggtggacatgatattgcgtatgctcaatatttagcaacacgtaaagtctatccaacacaatctattggtgtgataaatattgatgcgcattttgatacacgtgctgaacaacaatctacatctggaacgagctttagacaaattttagaagaagatgaaaacacagattatttagtgcttggtattgctcaaggtggtaatacgcaaagtttatttgattatgctaaagagaaaaagattgattatgtctttgcagatgaattattgagtcacgtatcaccaacaattaaagatatgattgaacgttttgtacatgaacatgatgtcattatgtttacgatttgtatggatgtcattgatagtgcgtttgcgcctggggtaagtgcgccggcagtgttaggtttgtatccacatactgttcttgaattagcaaaacgtattattccaagtgataaggtgtcttcagttagtattgctgagatgaatccaacatatgacgctgacaatagaactgctaagctcgttgctaatttagtgcatcattttttaaaa

SEQ ID NO: 4348 - protein, 311 aa, Staphylococcus aureus
  MISC_FEATURE (1)..(311): hypothetical protein
VYKQGEPNLWTGRLDSETDPKKFRHFQTVTFEDLSKLEKSSMPSGVGILGYAVDKGVALNKGRIGAKEGPDAIKQAFAGLPDLNQCETLVDYGNVYHDHEELIDTQKEFAMLAAKSIANHRQTFLLGGGHDIAYAQYLATRKVYPTQSIGVINIDAHFDTRAEQQSTSGTSFRQILEEDENTDYLVLGIAQGGNTQSLFDYAKEKKIDYVFADELLSHVSPTIKDMIERFVHEHDVIMFTICMDVIDSAFAPGVSAPAVLGLYPHTVLELAKRIIPSDKVSSVSIAEMNPTYDADNRTAKLVANLVHHFLK

SEQ ID NO: 4349 - DNA, 1257 bp, Staphylococcus aureus
atgaagaacaataaaatttctggttttcaatgggcaatgacgattttcgtcttctttgtcattacaatggcgttatccattatgctcagagatttccagtctataattggtgtcaaacactttatatttgaagttacagatctagcaccattaattgctgcaatcatttgtatactcgttttcaaatataaaaaggtccaacttgcaggtttaaaattctcaatcagcctgaaagtaattgaacgtctattgctagctttaattttacctttaattattctaattattggtatgtacagctttaatacatttgcagatagctttattttattacaatcaacaggcttatcagtacctattacacacattctgattggacatattctgatggcgttcgtagtagaattcggattccgttcatacttacaaaatattgttgaaacgaaaatgaacacgttctttgcaagtattgttgttggtttgatgtattcagttttctcagcaaatacaacttatggtacagaatttgctgcttataacttcctttatacattctcattctctatgattcttggtgaattaattagagcgactaaaggacgtacaatttatattgcaacgacattccatgcttcaatgacattcggacttattttcttgtttagcgaagaaatcggcgatctattttcaatcaaagtcatcgccatttcaacagcaatcgttgcagtaggatacattggtttaagcttaattatccgaggtattgcatatttaacaacaagacgaaaccttgaagaacttgagcctaataattatttagaccatgtcaatgacgatgaagaaactaatcatactgaggctgaaaaatcttcttcaaatattaaagatgctgaaaaaacaggtgtagctactgcatcaacggttggtgttgctaaaaatgatactgaaaatacagtggctgacgaaccaagcattcatgaaggtactgaaaaaacagaacctcaacatcacataggtaatcaaactgaatctaatcatgatgaagatcatgacatcacttcggagtcagtagaatcagcagaatcagttaaacaagcaccacaaagtgacgatttaacaaacgattcaaatgaagatgaaatagagcaatcattaaaagaacctgcgacttataaagaagacagacgttcatcagttgtaattgatgcagaaaaacatatcgaaaaaactgaagaacaatcttcagataaaaacaaa

SEQ ID NO: 4350 - protein, 419 aa, Staphylococcus aureus
  MISC_FEATURE (1)..(419): hypothetical protein
MKNNKISGFQWAMTIFVFFVITMALSIMLRDFQSIIGVKHFIFEVTDLAPLIAAIICILVFKYKKVQLAGLKFSISLKVIERLLLALILPLIILIIGMYSFNTFADSFILLQSTGLSVPITHILIGHILMAFVVEFGFRSYLQNIVETKMNTFFASIVVGLMYSVFSANTTYGTEFAAYNFLYTFSFSMILGELIRATKGRTIYIATTFHASMTFGLIFLFSEEIGDLFSIKVIAISTAIVAVGYIGLSLIIRGIAYLTTRRNLEELEPNNYLDHVNDDEETNHTEAEKSSSNIKDAEKTGVATASTVGVAKNDTENTVADEPSIHEGTEKTEPQHHIGNQTESNHDEDHDITSESVESAESVKQAPQSDDLTNDSNEDEIEQSLKEPATYKEDRRSSVVIDAEKHIEKTEEQSSDKNK

SEQ ID NO: 4351 - DNA, 684 bp, Staphylococcus aureus
atgaaagatgtcaaagcactcaagttaatgacattaaatgatgttttaagtcaaatcaatggtgacatgacgctgggaattggtacaggaagtacaatggaattactcttacctcaaatggcgcaactaattaaagaacgtggttacaatattacaggtgtatgcacttctaataaaattgcatttttagcaaaagaattaggtattaaaatatgtgaaatcaatgatgttgatcatatcgacttagcaattgatggtgctgatgaagtagatccatctttaaatataattaaaggtggcggtggtgcgctgttcagagagaaagttatagatgaaatggcatcgcgttttgttgtggttgtcgatgaaacgaaaatagttcaatacttaggtgagacgtttaagttaccagtagaggtggataaatttaactggtatcacatattacgtaaaattgaatcatacgctgatataaaagtagaacgtcgtgtaaacgaagatgtcgcatttataactgataatggcaattatattttagattgtaagttaccaaaaggaattgacccatataagttccatgagtatttaattcatctgacaggtgtgtttgagacaggatacttcttagatatggcagatcaagttattgtaggcactcaagagggtgttaaaattttagaaaaa

SEQ ID NO: 4352 - protein, 228 aa, Staphylococcus aureus
  MISC_FEATURE (1)..(228): hypothetical protein
MKDVKALKLMTLNDVLSQINGDMTLGIGTGSTMELLLPQMAQLIKERGYNITGVCTSNKIAFLAKELGIKICEINDVDHIDLAIDGADEVDPSLNIIKGGGGALFREKVIDEMASRFVVVVDETKIVQYLGETFKLPVEVDKFNWYHILRKIESYADIKVERRVNEDVAFITDNGNYILDCKLPKGIDPYKFHEYLIHLTGVFETGYFLDMADQVIVGTQEGVKILEK

SEQ ID NO: 4353 - DNA, 651 bp, Staphylococcus aureus
atgatatcaattcacgcaatttcgacaggaaaaatccaagatttgccttatagctcgaaaagaccgatgcgctctgctttagataaaactaagatttcacaaacaacatggttatcttcaactggtttcactggtgatgaacaggcttataaagatcatggtggaccacataaagcagtttgtgggtttagtaagcataattatgcactgtatcaagatgatttacctacactacctactcatgcgatgtttggagagaatttaacatttgattatttagacgaatctgatgtttactttggtaatcaatatcgtttaggtgaagcgttaattgaggtttctgaaattagagaaccatactggaaaattcaagcaaaatataatattcctgatttagtgaagcgcatgtctacatctggtaaaacaggtttctatttccgggtattaaaacaaggctatgtatctccaaatgatcagctttacttaatacaagaagcaccaatcgaacatcgtttatctgtacaacagcttaatgacctttattataatgatagacaaaatcaagatatgttacgatatgcactaaacaatccatttctgtcaccaacaagacgcgataaacttcaaaaaatgtataacagaacattgaaa

SEQ ID NO: 4354 - protein, 217 aa, Staphylococcus aureus
  MISC_FEATURE (1)..(217): conserved hypothetical
MISIHAISTGKIQDLPYSSKRPMRSALDKTKISQTTWLSSTGFTGDEQAYKDHGGPHKAVCGFSKHNYALYQDDLPTLPTHAMFGENLTFDYLDESDVYFGNQYRLGEALIEVSEIREPYWKIQAKYNIPDLVKRMSTSGKTGFYFRVLKQGYVSPNDQLYLIQEAPIEHRLSVQQLNDLYYNDRQNQDMLRYALNNPFLSPTRRDKLQKMYNRTLK

SEQ ID NO: 4355 - DNA, 111 bp, Staphylococcus aureus
atgattaaaagtatcggcatttatataatatttatgttatttggcggaattttgaataggttatcaagaatcgtatcaaatgaagtgacatcattaatatacagtttgaaa

SEQ ID NO: 4356 - protein, 37 aa, Staphylococcus aureus
MIKSIGIYIIFMLFGGILNRLSRIVSNEVTSLIYSLK

SEQ ID NO: 4357 - DNA, 831 bp, Staphylococcus aureus
atggctattaaaaagtataagccaataacaaatggtcgtcgtaatatgacttcgttagatttcgcagaaatcacgaaaactacacctgaaaagtcattattaaaaccgctaccgaaaaaagcgggacgtaacaaccaaggtaaattgactgtaagacaccatggtggtggacacaaacgtcaataccgtgttatcgatttcaaacgtaacaaagatggtatcaatgcaaaagttgattctattcaatatgatccaaaccgctcagcaaacatcgctttagttgtatatgcagacggtgaaaaacgatatatcattgctcctaaaggattagaagtaggtcaaatcgttgaaagtggtgctgaagctgacatcaaagttggtaacgcattaccattacaaaacattccagttggtacagtagtacacaacatcgagcttaaacctggtaaaggtggacaaatcgctcgttcagctggtgcaagtgctcaagtacttggtaaagaaggtaaatacgtattaatcagattaagatctggtgaagttcgtatgatcttatctacttgccgtgctacaatcggtcaagttggtaacctacaacacgaattagttaacgttggtaaagccggacgttcaagatggaaaggtatccgtccaacagttcgtggttctgtaatgaaccctaacgatcacccacacggtggtggtgaaggtcgtgctcctatcggtagaccatctccaatgtcaccatggggtaaacctacgcttggtaagaaaactcgtcgtggtaaaaaatcatcagacaaacttatcgttcgtggacgtaagaaaaaa

SEQ ID NO: 4358 - protein, 277 aa, Staphylococcus aureus
  MISC_FEATURE (1)..(277): 50S ribosomal protein L2
MAIKKYKPITNGRRNMTSLDFAEITKTTPEKSLLKPLPKKAGRNNQGKLTVRHHGGGHKRQYRVIDFKRNKDGINAKVDSIQYDPNRSANIALVVYADGEKRYIIAPKGLEVGQIVESGAEADIKVGNALPLQNIPVGTVVHNIELKPGKGGQIARSAGASAQVLGKEGKYVLIRLRSGEVRMILSTCRATIGQVGNLQHELVNVGKAGRSRWKGIRPTVRGSVMNPNDHPHGGGEGRAPIGRPSPMSPWGKPTLGKKTRRGKKSSDKLIVRGRKKK

SEQ ID NO: 4359 - DNA, 801 bp, Staphylococcus aureus
atgacacattataaattttatgaagcaaacgttgagaccaatcaagttttagtatttctgcatggatttcttagcgacagccgtacttatcataatcacatcgaaaaatttactgataactatcatgtcatcactatagacttaccaggccatggcgaagatcagtcttcaatggatgaaacgtggaattttgattatattacgacgttgttagaccgaattttagataaatataaagataaatcaataacattgtttggatattcaatgggtgggcgtgttgcattatattatgcaattaatggtcacatccctatatctaatttgatattagaaagtacgtcaccaggtattaaagaagaagcaaatcaattggaacgccgtcttgttgatgatgcacgtgctaaagtattagacatagcaggtattgaattatttgttaatgattgggaaaagttgccattatttcaatcgcaactagaattaccagttgaaatacaacatcaaataagacaacaacgattgtctcaatcgccacataaaatggccaaagcattaagagattatggtacaggtcaaatgccaaacttatggccgcgcctgaaagaaattaaagtaccaacattaatattagctggagaatatgatgaaaaatttgtacagattgcgaaaaaaatggcaaatttaattcctaatagtaaatgtaaattaatttctgctacaggtcatacaattcatgtggaagatagtgatgaatttgatacaatgatattaggatttttaaaggaggagcaaaatgac

SEQ ID NO: 4360 - protein, 267 aa, Staphylococcus aureus
  MISC_FEATURE (1)..(267): hypothetical protein
MTHYKFYEANVETNQVLVFLHGFLSDSRTYHNHIEKFTDNYHVITIDLPGHGEDQSSMDETWNFDYITTLLDRILDKYKDKSITLFGYSMGGRVALYYAINGHIPISNLILESTSPGIKEEANQLERRLVDDARAKVLDIAGIELFVNDWEKLPLFQSQLELPVEIQHQIRQQRLSQSPHKMAKALRDYGTGQMPNLWPRLKEIKVPTLILAGEYDEKFVQIAKKMANLIPNSKCKLISATGHTIHVEDSDEFDTMILGFLKEEQND

SEQ ID NO: 4361 - DNA, 1017 bp, Staphylococcus aureus
atgatagttgaagttgagcaccaaagacaaggtgtagatttaatcaaaattgataatgatgaaactaaaattatttttacgaattatggagcaagagtagtgtcttggaaatatcatgataataatattgttcttggaaatgttgttgaagcggatgaattttatcatagtaatccttttaaatttggtgcttctataggaagatatagcggtagaattgataatgctaaatttaagttgaaaggtaaagaatatcagttagaaaaaaacaacggtgaacatcatttacatggtggatgtcatggtttggacaataagttatttgattatgaaattagaaatgaaattgctcaaattaaagttatatttaagacggtgttgaaatcagctgatgatcatttcccgggtgatatcgatgtgacgattacacatatttatgatgcggatcaccaatggtcgattgaatacgaagcagttgcatcagaagacacattgtttagtcctacgaatcatgtgtacttcaatttgaatcgagataataatgtcgttgataatcatcgcatttcaagtaatcaattagatatgtatgtattagatgagcgaaatattgttacaggtgatattctagatttacatgaagtgtttgaagataacaagataaaattgagtgatatttttacatcacaacatgcgcaattaagccaacaaatgacacgttttggtggtctcgatcacccatttacagttggtgaacataaaatgtatgttgaaaatcatgaatttatgttagaggtcgatacagatatgcctcatgttgtgttctttacttttaaccagcctgatgagtgggatagtccatttaatatttataaaccacattctggctttacattagaaacacaatttttaccaaatgatattaatttatatggtgaaaaagcaccgtcaattttaaaagctggtgaagtgttcaattcgaaaacaagtttccgtatcgaagaaaaagtagaaaatgat

SEQ ID NO: 4362 - protein, 339 aa, Staphylococcus aureus
  MISC_FEATURE (1)..(339): hypothetical protein
MIVEVEHQRQGVDLIKIDNDETKIIFTNYGARVVSWKYHDNNIVLGNVVEADEFYHSNPFKFGASIGRYSGRIDNAKFKLKGKEYQLEKNNGEHHLHGGCHGLDNKLFDYEIRNEIAQIKVIFKTVLKSADDHFPGDIDVTITHIYDADHQWSIEYEAVASEDTLFSPTNHVYFNLNRDNNVVDNHRISSNQLDMYVLDERNIVTGDILDLHEVFEDNKIKLSDIFTSQHAQLSQQMTRFGGLDHPFTVGEHKMYVENHEFMLEVDTDMPHVVFFTFNQPDEWDSPFNIYKPHSGFTLETQFLPNDINLYGEKAPSILKAGEVFNSKTSFRIEEKVEND

SEQ ID NO: 4363 - DNA, 324 bp, Staphylococcus aureus
atgttatatccgatttttatatttatattagctggcttatgtgaaataggtgggggatacctgatttggctgtggcttagggaaggacagtcttcacttgttgggctaataggcggtgcgatactcatgttatatggtgtcattgcgacatttcaatcatttccatcattcggaagagtatatgcagcatatggtggcgtatttatcatcatgagtttgatttttgcgatggtcgtagataaacaaatgccagataaatatgatgttatcggtgcaatcatttgtattgtaggtgttttagtaatgttgctacccagcagagct

SEQ ID NO: 4364 - protein, 108 aa, Staphylococcus aureus
  MISC_FEATURE (1)..(108): conserved hypothetical
MLYPIFIFILAGLCEIGGGYLIWLWLREGQSSLVGLIGGAILMLYGVIATFQSFPSFGRVYAAYGGVFIIMSLIFAMVVDKQMPDKYDVIGAIICIVGVLVMLLPSRA

SEQ ID NO: 4365 - DNA, 183 bp, Staphylococcus aureus
gtgtatttaaaaaataaaattgatgagagtgacacacatttatcatataaaatgatgatgaaagcgtgttactcttatttttttatatttagctatagaataatgtctaaaaaagtgtacaatatgaatgtgaaaacgaactttttaaaatgggaatgtgaagtaagaagaaatgtaaacaaa

SEQ ID NO: 4366 - protein, 61 aa, Staphylococcus aureus
VYLKNKIDESDTHLSYKMMMKACYSYFFIFSYRIMSKKVYNMNVKTNFLKWECEVRRNVNK

SEQ ID NO: 4367 - DNA, 1251 bp, Staphylococcus aureus
ttgagaaggttggtggcaaggatgcataagttttgggcgacatttactttgacatatatcaaaaaaattaaagctaaatcatttgtaatttttatgattattattgctgccttaatgattggcctatctaacattgataagattattaacatgtttgatgatggtccagataaaattggtgtagcagcaccgaatgaacaaatctataaggttttcaagcaacaggcgaatacatttcatagtgatgctaagtttactaaagtttctatagaagatgctgaaaaagaagtaaaaaaacataaacttgataaagcttatattatcaaggtgaatcaaaatcgcacgttacaagggacaatcattagtgagaagcgagtaagtcatgaagattcacaaaaagtacaagcactgcttacagctattcaaacaaatatggtagccggggaattaaatatcaacaaagaagacttacaaaaattacaagcacaaagtaaagttgataataaggtgatttctaatgatgaagtcgataaagtatcagaaggacaaaagattttcaactatgctttagcttatggcattatctttctaatgttcttcattgttttaaattatgcatctcaaatagctatggaaattgctagtgagaaaacatcgcgtgtcattgaaatgattattacaagtatttcaccaatccaacatatttttgctaaaattttaggcgttatagcagttgccgtgactcagattattttaattgtattgatggcagttatatgcatttttgcctttgacttaaaagacttgctacaaggttttaacgtggaaatgaatcaattgtcttggcaaattattattgtcggaattataagtagtattgttggaattacggcgtatgtattacttgcagccatcctcggatcattaacatctagaatagaagatttaaatcaatctttgatgccactgacattacttggtatgattgcattttatatcgcgatattcacgataaataatcctgatggacaacttgctttaatcacaagttatattccgtttttagcgccatttcaattagttgtacgcgctcaaacttcagggcttcaaatatatgaggtcatcttaagttctttaatctcaattgtaatggtagctgtcttgatatggattgcaattaaaacatataaagattcagtacttacatttgaacgtggcttatttaattcaatgaaacgtgtatttaaaaaa

SEQ ID NO: 4368 - protein, 417 aa, Staphylococcus aureus
  MISC_FEATURE (1)..(417): conserved hypothetical
LRRLVARMHKFWATFTLTYIKKIKAKSFVIFMIIIAALMIGLSNIDKIINMFDDGPDKIGVAAPNEQIYKVFKQQANTFHSDAKFTKVSIEDAEKEVKKHKLDKAYIIKVNQNRTLQGTIISEKRVSHEDSQKVQALLTAIQTNMVAGELNINKEDLQKLQAQSKVDNKVISNDEVDKVSEGQKIFNYALAYGIIFLMFFIVLNYASQIAMEIASEKTSRVIEMIITSISPIQHIFAKILGVIAVAVTQIILIVLMAVICIFAFDLKDLLQGFNVEMNQLSWQIIIVGIISSIVGITAYVLLAAILGSLTSRIEDLNQSLMPLTLLGMIAFYIAIFTINNPDGQLALITSYIPFLAPFQLVVRAQTSGLQIYEVILSSLISIVMVAVLIWIAIKTYKDSVLTFERGLFNSMKRVFKK

SEQ ID NO: 4369 - DNA, 897 bp, Staphylococcus aureus
atgggacttgtaattgaacatgttacgaaacgttttggcaagatgacggcagtaaatgatatttcattaaagttagaatcaggtaaaatgttaggttttctaggaagaaatggtgcaggtaaaacaacgacatttcgtatgattttaggcttaagtgaaccaactgaaggacacattacgtataacggtaaaaaactagataaaacaatgtacaatcgtattggttatttaccggaagaacgcggtttacatgggaaattgacagttgaagaagaattgaaatatttggcaactttaaagggaatgtcaaaaacagaaatacaacagcaaatatcgtattggcttgagcgttttgatattactgaaaaccgcaaaaaacgaattgatagtctatcaaaagggaatcaacaaaaaattcagctgttagcaagtatgttacataaaccagaattactaatattagatgagcctttcagtggtctagacccagttaatgttgagttattaaaagaagcagttaaagacttaaatgattggggcagtacaatcgtttatagttctcaccgtatggagcatgttgaagaattatgtgatgatgtttgtattttagataaaggtcaacttgttgtttctggtgatatcaatcatgtacgtgcatctaatggtaacaagaaagttgtcattgaatcagaaacaacactaccagatttaacaaacattagaggcatcattcatagtgaaaacatgaagcaaggtcttcagttgacgattgagaatgaagacgtagccaaagatatttatcaagttgtggcacatcaaggttatgttaaacgattccaagttgtagaaccatcattacaagatatattcattgagaaggttggtggcaaggatgca

SEQ ID NO: 4370 - protein, 299 aa, Staphylococcus aureus
  MISC_FEATURE (1)..(299): hypothetical protein
MGLVIEHVTKRFGKMTAVNDISLKLESGKMLGFLGRNGAGKTTTFRMILGLSEPTEGHITYNGKKLDKTMYNRIGYLPEERGLHGKLTVEEELKYLATLKGMSKTEIQQQISYWLERFDITENRKKRIDSLSKGNQQKIQLLASMLHKPELLILDEPFSGLDPVNVELLKEAVKDLNDWGSTIVYSSHRMEHVEELCDDVCILDKGQLVVSGDINHVRASNGNKKVVIESETTLPDLTNIRGIIHSENMKQGLQLTIENEDVAKDIYQVVAHQGYVKRFQVVEPSLQDIFIEKVGGKDA

SEQ ID NO: 4371 - DNA, 99 bp, Staphylococcus aureus
gtgcgttcgaagatttcacgatatatcaagaacaatgttatttccaatgattatgacagtattcagtattatattttatatagtattacagattatcga

SEQ ID NO: 4372 - protein, 33 aa, Staphylococcus aureus
VRSKISRYIKNNVISNDYDSIQYYILYSITDYR

SEQ ID NO: 4373 - DNA, 669 bp, Staphylococcus aureus
atgattaacgaaagggagattacaatggaacaattacctcaagtaggttttatgaaatcattcgttttattttggaaaaattatgtaaattttaaggggagatcaagacgtagtgaatattggtatatggcactatggcatttgatacttatggttccagctgtgtgtgtgctaataataaacctatttctattctttatttctatagcggcggataacgaaacattaatagttatgagtatattgatgattatccttacatctgtgtatacttttgtctatagtttggcaacgtttattccaaatttagcgttgtgcgttcgaagatttcacgatatatcaagaacaatgttatttccaatgattatgacagtattcagtattatattttatatagtattacagattatcgatagttattatgacagtgattttacattaatgccgatgggtcttaatattttgttagtacttctttattttgtttatttaggcctaacaattgttatgatagtattcctatgctttgacagtaagccggcaaataaatatggcgaaagcccaaaatacccgtctacaattaaaaatcaaccagtgacatctgaaacaccggaaaaagcgtgtacatctgaaacaccgaaaacaccggaagaaacagataatcaattg

SEQ ID NO: 4374 - protein, 223 aa, Staphylococcus aureus
  MISC_FEATURE (1)..(223): conserved hypothetical
MINEREITMEQLPQVGFMKSFVLFWKNYVNFKGRSRRSEYWYMALWHLILMVPAVCVLIINLFLFFISIAADNETLIVMSILMIILTSVYTFVYSLATFIPNLALCVRRFHDISRTMLFPMIMTVFSIIFYIVLQIIDSYYDSDFTLMPMGLNILLVLLYFVYLGLTIVMIVFLCFDSKPANKYGESPKYPSTIKNQPVTSETPEKACTSETPKTPEETDNQL

SEQ ID NO: 4375 - DNA, 606 bp, Staphylococcus aureus
atggatttcgttaataatgatacaagacaaattgctaaaaacttattaggtgtcaaagtgatttatcaggataccactcaaacgtatacaggctacatcgtggaaacggaagcttacttaggtttgaatgatcgtgcggctcatggctatggcggtaaaataacacctaaagtcacgtcattatataaacgtggtggtacaatttatgcacatgtcatgcatacgcatttactcattaattttgtaacaaaatctgaaggtatacctgaaggcgtacttatccgcgcaattgaaccagaagaaggtttatccgctatgttccgtaacagaggtaagaaaggctacgaggtaacgaatggcccaggaaaatggactaaggcatttaacattccacgggctatcgatggcgctacgttaaatgactgtagattgtctattgatactaagaatcgtaaatatcctaaagatattattgctagtccacgaatcggtattccaaataaaggtgattggacacataaatctttacgttacacagtgaaaggtaatccatttgtgtctcgcatgcgtaaatcagattgtatgtttcccgaagatacttggaaa

SEQ ID NO: 4376 - protein, 202 aa, Staphylococcus aureus
  MISC_FEATURE (1)..(202): hypothetical protein
MDFVNNDTRQIAKNLLGVKVIYQDTTQTYTGYIVETEAYLGLNDRAAHGYGGKITPKVTSLYKRGGTIYAHVMHTHLLINFVTKSEGIPEGVLIRAIEPEEGLSAMFRNRGKKGYEVTNGPGKWTKAFNIPRAIDGATLNDCRLSIDTKNRKYPKDIIASPRIGIPNKGDWTHKSLRYTVKGNPFVSRMRKSDCMFPEDTWK

SEQ ID NO: 4377 - DNA, 1212 bp, Staphylococcus aureus
ttgaaaatgatagaacttaatgcaattacaacattatgtttagcttgtatcctttatttacttggtaaggctatcgttaatcacgttaattttttaaaacgtatttgtataccagcaccagtgattggcggcttaatctttgctattttagttgcggctttggattcatttggcatggttaagattaaattagatgcttcattcattcaagatttcttcatgttagcattctttacgacaatcggtcttggtgcatcattgaaattatttaaattaggtggcaaagtcttgctattatactttatgttttgtgctatcatttcagtcattcaaaacatagttggtgtatcactagcaaaagtattaaatattaaacctttgttaggattaacagcaggttccatgtctatggaaggcggtcatggtaatgctgctgcttatggtaagacaattcaagatttaggtattgattcggcactgacagcggctcttgcagctgcaactttaggtcttgtatttggagggcttatcggtggtccagttgtaaaatttttaatcaaacgttataacttaaagcctcaacatagtgacgatacatttaaagattatagccaagtagcatataacgaacatttacatagtaaatttaatgccactgaagtattcttcattcaatttacaatcgttgtattctgtatggcagttggaagttatttcagtcatttgtttacagctcaaacagggattaatgttccaatttacgttggctcattatttgtagctgttattgtccgaaatatctctgaaagttttaattttaatattgtagatttaaaaattactaatcaaattggcgatgtcgcattaggtattttcttatctcttgcgctaatgagcattcaattaatcgaaatttataaacttgctatacctcttattattatcgttttagttcaagttgtcgttatgattttatttgctgttttaattttatttagaggtttaggaaaagattatgatgctgcagtaatggtaggtggttttatcggtcatgggcttggtgcaacgccaaatgccatggcaaatttagatgttattactaaaaaatatggaaactcacctaaagcatatttagttgtacctattgttggtgcattcttaatcgatttaattggtgttatagtcattatgggattcatacaatggtttagt

SEQ ID NO: 4378 - protein, 404 aa, Staphylococcus aureus
  MISC_FEATURE (1)..(404): hypothetical protein
LKMIELNAITTLCLACILYLLGKAIVNHVNFLKRICIPAPVIGGLIFAILVAALDSFGMVKIKLDASFIQDFFMLAFFTTIGLGASLKLFKLGGKVLLLYFMFCAIISVIQNIVGVSLAKVLNIKPLLGLTAGSMSMEGGHGNAAAYGKTIQDLGIDSALTAALAAATLGLVFGGLIGGPVVKFLIKRYNLKPQHSDDTFKDYSQVAYNEHLHSKFNATEVFFIQFTIVVFCMAVGSYFSHLFTAQTGINVPIYVGSLFVAVIVRNISESFNFNIVDLKITNQIGDVALGIFLSLALMSIQLIEIYKLAIPLIIIVLVQVVVMILFAVLILFRGLGKDYDAAVMVGGFIGHGLGATPNAMANLDVITKKYGNSPKAYLVVPIVGAFLIDLIGVIVIMGFIQWFS

SEQ ID NO: 4379 - DNA, 819 bp, Staphylococcus aureus
atgactaacagacaatgggaaacacttagagaatatgatgaaatcaaatatgaattttacgaagggattgctaaggtaacaataaatcgccctgaagtacgcaatgcgtttacacctaaaacagttgctgaaatgattgacgcattttcacgtgcacgtgatgatcaaaacgtttcagttatcgtattaactggtgaaggtgatttagcattctgttctggtggtgaccagaagaaacgtggacatggtggttatgtaggtgaagaccaaatccctcgcttaaatgtattagatttacagcgtttaattcgtattattccaaaaccggttatcgcgatggtaaaaggttatgctgtaggtggcggtaatgtactaaatgttgtttgtgacttaacgattgctgctgataatgctatttttggacaaactggtcctaaagtaggttcatttgatgcgggttatggttcaggatatttagcacgtatcgttggacataagaaagcacgtgaaatttggtacttatgtcgtcaatacaatgcacaagaagctttagatatgggtctagtaaatacagtggtacctttagagaaagttgaagatgaaactgtgcaatggtgtaaagagattatgaaacactcaccaacagcgttacgattccttaaagcagctatgaatgctgacacagatggtttagctggtttacaacaaatggctggggatgcaacattgctttattacacaactgatgaagcgaaagaaggccgtgatgcgtttaaagaaaaacgtgatcctgacttcgatcaattccctaaattccca

SEQ ID NO: 4380 - protein, 273 aa, Staphylococcus aureus
  MISC_FEATURE (1)..(273): naphthoate synthase
MTNRQWETLREYDEIKYEFYEGIAKVTINRPEVRNAFTPKTVAEMIDAFSRARDDQNVSVIVLTGEGDLAFCSGGDQKKRGHGGYVGEDQIPRLNVLDLQRLIRIIPKPVIAMVKGYAVGGGNVLNVVCDLTIAADNAIFGQTGPKVGSFDAGYGSGYLARIVGHKKAREIWYLCRQYNAQEALDMGLVNTVVPLEKVEDETVQWCKEIMKHSPTALRFLKAAMNADTDGLAGLQQMAGDATLLYYTTDEAKEGRDAFKEKRDPDFDQFPKFP

SEQ ID NO: 4381 - DNA, 1047 bp, Staphylococcus aureus
atgagtgattttcaaagagaacagagaaaaaatgaacatgttgaaatagcaatggcccaatctgacgcaatgcattcagattttgataagatgcgttttgtgcatcattctatcccatcaattaatgtaaatgatatcgatttgacatcacagacgcctgacttaacgatggcatatccggtttatattaatgcaatgacgggtggtagcgagtggacgaaaaacatcaatgaaaagctagctgtagttgcaagagaaactggcttagcgatggcagttggatcaacacatgcggcattgagaaatccacgcatggctgagacgtttacgattgcgcgaaaaatgaatcctgaaggcatgatttttagcaatgttggtgcggacgtaccagtagaaaaggctttggaagcagttgaattacttgaggcacaagcgttacaaatccatgttaattctcctcaagaattagttatgcctgaagggaatcgtgaatttgtgacttggttagataatatagcgtcgattgtatcacgagtgtctgttccagtcattataaaagaagttggatttggtatgagcaaagaattaatgcatgacttacaacaaataggcgtcaagtatgtcgatgttagtggcaaaggtggtactaactttgtagatattgaaaatgaacgtcgtgcaaataaagatatggattacttatcatcatggggacagtctacagttgagtcattacttgaaacaacggcttatcaaagcgaaatttcagttttcgcgagtggtggtttacgtacaccactcgatgcaattaaaagtttagcacttggtgcaaaggcaactggtatgtcacgtccgtttttaaatcaagttgaaaataatggcattgcacatacagtagcttatgtagaatcatttattgaacacatgaaatcaataatgacgatgttagatgctaaaaatattgacgacttaacacaaaaacaaatcgtatttagtccggaaatattgtcatggatagaacaacgtaacttgaatatacatcgagga

SEQ ID NO: 4382 - protein, 349 aa, Staphylococcus aureus
  MISC_FEATURE (1)..(349): isopentenyl diphosphate
MSDFQREQRKNEHVEIAMAQSDAMHSDFDKMRFVHHSIPSINVNDIDLTSQTPDLTMAYPVYINAMTGGSEWTKNINEKLAVVARETGLAMAVGSTHAALRNPRMAETFTIARKMNPEGMIFSNVGADVPVEKALEAVELLEAQALQIHVNSPQELVMPEGNREFVTWLDNIASIVSRVSVPVIIKEVGFGMSKELMHDLQQIGVKYVDVSGKGGTNFVDIENERRANKDMDYLSSWGQSTVESLLETTAYQSEISVFASGGLRTPLDAIKSLALGAKATGMSRPFLNQVENNGIAHTVAYVESFIEHMKSIMTMLDAKNIDDLTQKQIVFSPEILSWIEQRNLNIHRG

SEQ ID NO: 4383 - DNA, 945 bp, Staphylococcus aureus
atggctttaaagatacggtatcaaactacatatgaaccgtttaaagtagttgatgatatcaaagagataccaaaagatgcgactattgtttggtatgattttgatgaaccgaatgaacaagaaaatgaatggtttaaagcacattttaattttaatgatttagaagtggatgatgcaattaacggtatgccacgagctaaatataaatcttataaagattatcaatacttagtattccatagtattatggggtcaaactattcaccaatagcactaaatatttttatacaagacaatgtattagtaacatatcatcatcaaacgttggaatcattaaataaagtagtctataagtatatgaatacattagatgcagaattagattgtgcagatgtcgtcatattaattttagatatgatggttgataaatatttcaactttgtatatgcacttgaagatagtgtttatcattttgaagaccgccatgtagatgatcgctttaataaaatggtcatggatagtgtctttaagttacgttcggatttgattaaagtaaaacgtgtactgtttcctatgcaagagctaattgatacaatgaaacaaaatggtgatttgattatagataataaacattcgctatacattcaacatatcgatgaccacttgattaagcaacgtaatatcattcgtactgctcaagaaatgacaaacgaaatacgagaaaattttgagtcatacacgtcatttagaatgaatagtattatgcaagtactgacattagtatcagttatattttcaccgttaacattcatagctgggatttatggtatgaactttgtaaatatgccggcattacatttacattatggatattatatttgcttagctgtaatgtttgttatagctgtcgtattaatcatctttttcagacgtaaaaaatggttt

SEQ ID NO: 4384 - protein, 315 aa, Staphylococcus aureus
  MISC_FEATURE (1)..(315): hypothetical protein
MALKIRYQTTYEPFKVVDDIKEIPKDATIVWYDFDEPNEQENEWFKAHFNFNDLEVDDAINGMPRAKYKSYKDYQYLVFHSIMGSNYSPIALNIFIQDNVLVTYHHQTLESLNKVVYKYMNTLDAELDCADVVILILDMMVDKYFNFVYALEDSVYHFEDRHVDDRFNKMVMDSVFKLRSDLIKVKRVLFPMQELIDTMKQNGDLIIDNKHSLYIQHIDDHLIKQRNIIRTAQEMTNEIRENFESYTSFRMNSIMQVLTLVSVIFSPLTFIAGIYGMNFVNMPALHLHYGYYICLAVMFVIAVVLIIFFRRKKWF

SEQ ID NO: 4385 - DNA, 531 bp, Staphylococcus aureus
gtgtatgtcttaatttattttagtatgatagtcactaaggagatggttattatcaaacaactttttacacatactcaaaccgtaacatctgaattcattgaccataacaatcatatgcatgatgcaaattataatatcatttttagtgacgtcgtgaatcgttttaattacagccacggtctttctttaaaagaacgcgaaaatttagcatatacgctatttacactagaagaacatacgacatacctctcagaattgtctcttggcgatgtatttactgttactttatatatttatgattacgattataagcggttgcatttatttttaacattaactaaagaagatggtacactagcatcaacaaatgaagtaatgatgatgggaattaatcagcacacacgtcgttctgatgcttttcctgaatcattttcaacacaaatagcacactattataaaaatcaatcaactatcacttggcctgaacaattaggacataaaatagcaattccacacaaaggagcattaaaa

SEQ ID NO: 4386 - protein, 177 aa, Staphylococcus aureus
  MISC_FEATURE (1)..(177): conserved hypothetical
VYVLIYFSMIVTKEMVIIKQLFTHTQTVTSEFIDHNNHMHDANYNIIFSDVVNRFNYSHGLSLKERENLAYTLFTLEEHTTYLSELSLGDVFTVTLYIYDYDYKRLHLFLTLTKEDGTLASTNEVMMMGINQHTRRSDAFPESFSTQIAHYYKNQSTITWPEQLGHKIAIPHKGALK

SEQ ID NO: 4387 - DNA, 417 bp, Staphylococcus aureus
atgacagatgcattacaacaaaagattcatatcgaattactagatttattagatgatgttaagtttgaattaacagaattaaatgcacaaaaagggttatacattaacggaccagcaaatcagctacttaagcgtggcgtgcatatggcttatgttcaaggacaaaagcaagccatcgataatattatgactattgtggaacaacagcttgaagatcaacatttcctagaacattatgataaatttcaaaatgaggttgctcatcgcaattatgataaaacagctaactttgcagaacttagtgatattccacgtcaattcgataattttttagatcaattttatcaaattaaagggcaatactttatcatcacacatatcaatacacttattggtgattttcactcagaagctcat

SEQ ID NO: 4388 - protein, 139 aa, Staphylococcus aureus
  MISC_FEATURE (1)..(139): hypothetical protein
MTDALQQKIHIELLDLLDDVKFELTELNAQKGLYINGPANQLLKRGVHMAYVQGQKQAIDNIMTIVEQQLEDQHFLEHYDKFQNEVAHRNYDKTANFAELSDIPRQFDNFLDQFYQIKGQYFIITHINTLIGDFHSEAH

SEQ ID NO: 4389 - DNA, 918 bp, Staphylococcus aureus
ttgattagaaaccgtgttatgaatagcgttgtcaataaatatttgcttcacaatcgctcgattatgtttaaaaatgatcaagatgttgaaagatttttttataaaagagaaattgaaaatagaaaaaaacataagcagccttcaacattaaatgttaaagcaaatttagaaaaattgtcattagatgatatgcaagtctttcgctttaatttcagacatcaaattgataagaaaattttatatattcacggtggattcaatgcactacaaccatcaccgttccattggagattgttggataaaatcactttaagtacattatatgaggttgtactgcctatctatccaaagacaccagagtttcatattgacgatactttccaagcgatacaacgtgtttatgatcaattagtatctgaagtaggacatcaaaatgtcgtagtcatgggtgatggttcaggtggtgcactggcattatcctttgtacaatctcttttagataatcaacagccattaccgaataaattgtatttaatctcaccaattttagatgcaacactatctaataaagatatttcggacgccttaatcgaacaagatgcggttctaagtcagtttggtgtcaatgagattatgaaaaaatgggcgaatggcctaccattaacagataagcgcatatcgccaattaatggcacaatagaaggattgccaccagtttatatgtttggtggtggacgtgaaatgacacatcctgatatgaagctatttgaacaaatgatgttgcaacatcatcaatacattgagttttatgattatcctaagatggtacatgattttccaatttatccaattagacaatcacataaagctattaaacaaattgccaaatcgatagatgaggatgtaacacaaaataac

SEQ ID NO: 4390 - protein, 306 aa, Staphylococcus aureus
  MISC_FEATURE (1)..(306): hypothetical protein
LIRNRVMNSVVNKYLLHNRSIMFKNDQDVERFFYKREIENRKKHKQPSTLNVKANLEKLSLDDMQVFRFNFRHQIDKKILYIHGGFNALQPSPFHWRLLDKITLSTLYEVVLPIYPKTPEFHIDDTFQAIQRVYDQLVSEVGHQNVVVMGDGSGGALALSFVQSLLDNQQPLPNKLYLISPILDATLSNKDISDALIEQDAVLSQFGVNEIMKKWANGLPLTDKRISPINGTIEGLPPVYMFGGGREMTHPDMKLFEQMMLQHHQYIEFYDYPKMVHDFPIYPIRQSHKAIKQIAKSIDEDVTQNN

SEQ ID NO: 4391 - DNA, 636 bp, Staphylococcus aureus
atgacaaatccaaatcaacgattagaaccatttgatgagacatttcaacaaccgaatattcatcgtggtaagcgatatggtaagaaaaaacgttcattggtaagcatgattattcaaatcattgttgttatattaaccacaatcgctggatacagcatgtggaaacaacccatttttaatattgtcttcaccaaagaatctgtagattttgatggcattaaaaattttaacgagacaattggaaaaatgcatcaattaaatattaatttgggtaatatcaatgatttacaacaaggaatcgatcgcttaattttagtctttaacggtttctttattttatgtatcgttagcctagtcataacaatactgacaattgtatttaatcgcacagttctaaaagtagtaaatattttagtgttaacaattatgttagtcattacattgtatttcagttatattattaaagcactcgcacaagaaattgcagatgttttcaaaaaatattatttaaatgtaccaccagatcaagtgattacagaagctgacgctattcataacggcatcattttacttggctgtagcatcggtttacttgttataagcttattcttccgtaatcgcatgcctcgtttaaaa

SEQ ID NO: 4392 - protein, 212 aa, Staphylococcus aureus
  MISC_FEATURE (1)..(212): hypothetical protein
MTNPNQRLEPFDETFQQPNIHRGKRYGKKKRSLVSMIIQIIVVILTTIAGYSMWKQPIFNIVFTKESVDFDGIKNFNETIGKMHQLNINLGNINDLQQGIDRLILVFNGFFILCIVSLVITILTIVFNRTVLKVVNILVLTIMLVITLYFSYIIKALAQEIADVFKKYYLNVPPDQVITEADAIHNGIILLGCSIGLLVISLFFRNRMPRLK

SEQ ID NO: 4393 - DNA, 1929 bp, Staphylococcus aureus
atgactacgaccttcattattagctacattattttagcgctcattattgttggggttatcaatttatttttaataagatcaagaaaaaaaggcaaacgccaacaaaaggaacaacaatttacgacacgtcaatcaaatcaatctaaatttaaagctagtgatttagacaaaacaactgatcaatcgacacaacgtatgacgcatgaagagttgcgtgttgacaatcaagatgatcatagccaagttagtctaaatggttacacaaaggggtctgagaaagatcaagaagcattcactaataataaggatgaggaagcagttgctgctaaaaatcctgaatcagaagaatataaagtgaatgaaaaaataaaaaaagaacataaaaactttatttttggtgaaggtgtttcacgcggtaaaatattagcggcattattattcggtatgtttattgcgattttaaaccaaacattattaaatgttgctttaccaaaaattaatacggaatttaatatttctgcgtcaacagggcaatggttgatgacgggattcatgttagtaaacggtattttaataccaattacggcgtatctatttaataaatattcatatcgaaaattatttttagttgcgttagtactctttacaattggttcattaatctgtgcgatttcaatgaatttcccaatcatgatggttggacgtgtattacaagccattggtgcaggtgtactaatgccattaggttcaattgttattattacaatttatccacctgaaaaacgtggtgctgccatgggtacaatgggtatcgcaatgattttagcacctgcaattggtccaacattatcaggttatattgtacaaaattaccattggaatgtgatgttttacggtatgttcattatcgggattatcgctattttaattggttttgtatggtttaagttatatcaatatacaacaaaccctaaagctgatatcccaggtatcatttttagtacgattggttttggtgctttgttatatggtttctcagaagctggcaacaaaggttggggttcagtagagatagaaacaatgtttgcgattggtattatctttattattctattcgttattagagaattaagaatgaaatcaccaatgttgaatttagaagtattgaaattcccaacatttacattaacaacaattattaatatggttgtaatgttaagtttatatggtggtatgattttattaccgatttatttacaaaatttacgcggattctcagcattagattccggattgttattattacctggttctctaattatgggtctactaggaccatttgcaggtaaattgttagatactattggtttaaaaccattagctatctttggtattgctgtaatgacttatgcaacatgggaattaactaaattaaatatggatacaccatatatgacaatcatgggtatctatgtacttcgttcatttggtatggcatttataatgatgccaatggtaactgcagctattaatgcgttaccgggacgacttgcctctcatggtaatgctttcttaaatacgatgcgtcaattagcaggctctataggtacagcaatcttagttactgtaatgacaacacaaactacacaacacttatcagcttttggggaagagttagataaaacgaatcctgttgtacaagatcatatgcgtgaattagcatcacaatatggcggacaagaaggcgcaatgaaagtgttactacaatttgtaaataaactagcaacggttgaaggtattaatgatgcatttatagttgcaacgatatttagcatcatcgccttaattttatgtttatttttacaaagtaataaaaaagcaaaagctacagctcaaaagttagatgcagataatagtatcaatcatgaa

SEQ ID NO: 4394 - protein, 643 aa, Staphylococcus aureus
  MISC_FEATURE (1)..(643): hypothetical protein
MTTTFIISYIILALIIVGVINLFLIRSRKKGKRQQKEQQFTTRQSNQSKFKASDLDKTTDQSTQRMTHEELRVDNQDDHSQVSLNGYTKGSEKDQEAFTNNKDEEAVAAKNPESEEYKVNEKIKKEHKNFIFGEGVSRGKILAALLFGMFIAILNQTLLNVALPKINTEFNISASTGQWLMTGFMLVNGILIPITAYLFNKYSYRKLFLVALVLFTIGSLICAISMNFPIMMVGRVLQAIGAGVLMPLGSIVIITIYPPEKRGAAMGTMGIAMILAPAIGPTLSGYIVQNYHWNVMFYGMFIIGIIAILIGFVWFKLYQYTTNPKADIPGIIFSTIGFGALLYGFSEAGNKGWGSVEIETMFAIGIIFIILFVIRELRMKSPMLNLEVLKFPTFTLTTIINMVVMLSLYGGMILLPIYLQNLRGFSALDSGLLLLPGSLIMGLLGPFAGKLLDTIGLKPLAIFGIAVMTYATWELTKLNMDTPYMTIMGIYVLRSFGMAFIMMPMVTAAINALPGRLASHGNAFLNTMRQLAGSIGTAILVTVMTTQTTQHLSAFGEELDKTNPVVQDHMRELASQYGGQEGAMKVLLQFVNKLATVEGINDAFIVATIFSIIALILCLFLQSNKKAKATAQKLDADNSINHE

SEQ ID NO: 4395 - DNA, 645 bp, Staphylococcus aureus
atgaaaaagatgatattaattaatgtcattacggttgttgtactgttagcaattgggattgctggcttttatttttggaataaaacaacaagctatgtaacaactgataatgcaaaagtaaatggcgatcaaattaaaatagcaagtcctgcatctggacaaattaaatcacttaatgttaaacaaggtgacaaactcgataaaggtgacaaagtagcaattgttactgtacaaggtcaagatggcgaaacgaaagatatggatcttaaaatgcctcaaaaaggtacaattgccaaattagatggtatggaaggttcaatggtgcaagctggtaacccaatcgcttatgcatacaatttagatgatttatatgtaacagcaaatattgacgaaaaagatattaaagatgttgaagtaggtaaagatgttgatgtgactattgacggtcaaaaagcttctattaaaggtaaagttgatagtattggaaaagcaactgctgcaagcttttcattaatgccatcatcaaatagtgatggtaactacactaaagtttctcaagtaatacctgttaaaatcactctagaatcagaaccgtctaaacaagttgttcctggaatgaacgctgaagtaaaaatccataaaaat

SEQ ID NO: 4396 - protein, 215 aa, Staphylococcus aureus
  MISC_FEATURE (1)..(215): conserved hypothetical
MKKMILINVITVVVLLAIGIAGFYFWNKTTSYVTTDNAKVNGDQIKIASPASGQIKSLNVKQGDKLDKGDKVAIVTVQGQDGETKDMDLKMPQKGTIAKLDGMEGSMVQAGNPIAYAYNLDDLYVTANIDEKDIKDVEVGKDVDVTIDGQKASIKGKVDSIGKATAASFSLMPSSNSDGNYTKVSQVIPVKITLESEPSKQVVPGMNAEVKIHKN

SEQ ID NO: 4397 - DNA, 549 bp, Staphylococcus aureus
atgaaacgacaagccaaaatagaaattcaaaacgcacttgttgatttgatggctgaatatccttttcaagaaatatccactaaaatgatttgcgcgtattgtaatattaatcgttctactttttatgattattacaaagataaatttgatttattggataccatcaactcaaagcataaggaaaaattccaatttcttctaagcgcgctacatcataatttcgaaaatattaaacaggataagcttaaactttataaattcttcattattattgctaagtatatcaagcacaatgagcagtttttcaaagacattttagttacctatccaatgaaaacattattcatagactatataaatttagcgagagattactatcaacaaattatgaatgactatagtactacagtaaccaataaacagctttatgttacatatatcataggcggtcaagctggggtgtttattaattggctttcgaatggttgtaatgaatcacctgaagaagttgctgacattttattggctaatacgattaaacttcaaaac

SEQ ID NO: 4398 - protein, 183 aa, Staphylococcus aureus
  MISC_FEATURE (1)..(183): hypothetical protein
MKRQAKIEIQNALVDLMAEYPFQEISTKMICAYCNINRSTFYDYYKDKFDLLDTINSKHKEKFQFLLSALHHNFENIKQDKLKLYKFFIIIAKYIKHNEQFFKDILVTYPMKTLFIDYINLARDYYQQIMNDYSTTVTNKQLYVTYIIGGQAGVFINWLSNGCNESPEEVADILLANTIKLQN

SEQ ID NO: 4399 - DNA, 285 bp, Staphylococcus aureus
ttggaacttttggttttagcgataggatttatcattttaatagcaccagtgacaggtgttgcgacacttggttttacaatagctatggatgaaagtagtagtggtagagggagttcatcaagtttattaggtttagtacagtttttatttggtggtgttgcatcgccattagtgggggtaaaaggtgaagataatcctataccttacataattattattatagctacagcagttatattaattattttacagatttataatatgaaggtatttaaaacaaatcga

SEQ ID NO: 4400 - protein, 95 aa, Staphylococcus aureus
  MISC_FEATURE (1)..(95): TcaB protein
LELLVLAIGFIILIAPVTGVATLGFTIAMDESSSGRGSSSSLLGLVQFLFGGVASPLVGVKGEDNPIPYIIIIIATAVILIILQIYNMKVFKTNR

SEQ ID NO: 4401 - DNA, 936 bp, Staphylococcus aureus
atgaatgatttaacgcattttaacaagcgttcaccgatatttattattattttaggatctttgacggccattggagcattatcgatagatatgtttttgcctggattaccagatattagacatgattttcaaacaacgacgtctaacgcacaattaacattatcgatgtttatgattggtttagcgtttggtaatttgtttgctggtccaatttcagattcaactgggcgcagaaagccgcttattatagctatgattatttttacattagcaagtttaggtattgtttttgtacataatatttggctgatggttgcattaagatttcttcaaggagtgacaggtggcgcagcagcagttatttcaagagctatagcaagtgatatgtatagtggtaatgaactaactaagtttatggcattattgatgcttgttaatggtattgcaccagttgttgcgccaacaatagggggcataattttaaattattctgtctggcgtatggtctttgtcattctgactatctttggcttcgtcatggtcataggttctttattaaaagtacctgaatcattaacagtgacaaatcgtgagtcaagtagtggattaaagacaatgtttaaaaacttcaaaatattattgaagacgccacgttttgtattaccaatgctcattcaaggtatgacatttgtaatattatttacttatatttctgcgtctccgtttattattcaaaaaatttatggcatgactgcaatacaatttagttggatgtttgcaggaattggtattacgctcattatatcaagtcaacttactgggtaccttgttgattttatagactcacaaaaattgatgagaggcatgacgatgattcagattatcggtgtaattttagtgacgattgtattgcttaatcattggaacttttggttt

SEQ ID NO: 4402 - protein, 312 aa, Staphylococcus aureus
  MISC_FEATURE (1)..(312): TcaB protein
MNDLTHFNKRSPIFIIILGSLTAIGALSIDMFLPGLPDIRHDFQTTTSNAQLTLSMFMIGLAFGNLFAGPISDSTGRRKPLIIAMIIFTLASLGIVFVHNIWLMVALRFLQGVTGGAAAVISRAIASDMYSGNELTKFMALLMLVNGIAPVVAPTIGGIILNYSVWRMVFVILTIFGFVMVIGSLLKVPESLTVTNRESSSGLKTMFKNFKILLKTPRFVLPMLIQGMTFVILFTYISASPFIIQKIYGMTAIQFSWMFAGIGITLIISSQLTGYLVDFIDSQKLMRGMTMIQIIGVILVTIVLLNHWNFWF

SEQ ID NO: 4403 - DNA, 1380 bp, Staphylococcus aureus
atgaaatcttgcccgaagtgcggacaacaagcacaagatgatgtacagatatgtacacaatgtggacataaatttgatagtcgtcaagcattatatagaaagtcaaccgatgaagatatacaaactaataacatcaagatgagaaaaatggtgccttgggcaattggttttttcattttaatcttaattattatattgttctttttactaagaaacttcaattcacctgaagcgcaaactaaaatattagtgaatgcgattgagaataatgataaacaaaaagtagcaacattattaagtactaaagataataaagtagattctgaagaagcaaaagtatacattaactatatcaaagatgaagttgggcttaagcaatttgtcagcgaccttaaaaatacggtacataaattgaataagagtaagaccagcgtagcttcttatattcaaaccagatctggtcaaaatatattacgtgtaagtaaaaatggcacacgttatatctttttcgataatatgagctttactgcacctaccaagcaaccaattgttaaaccgaaagaaaaaacaaaatatgagtttaaatctggtggtaagaaaaagatggttatagctgaagcaaataaagtgacgccaataggtaattttataccggggacatatagaattccagctatgaaatcaactgagaacggtgattttgcaggccatttaaaatttgattttagacaaagtaattctgaaacggtagatgttactgaagattttgaagaagcaaatatatctgtaactttaaaaggcgatacaaaattaaatgatagttctaaaaaagtaactataaatgaccatgaaatggcattttcaagttccaaaacgtatggtccatatccacaaaataaagatattaccatttcagcttcaggtaaagcgaaagataaaacatttacaacacagacgaagacgattaaagctagcgatttaaaatacaatacagagataactttgaattttgacagtgaagatatcgaagactatgttgaaaagaaagaaaaagaagaaaacagcttgaagaacaaattgatagaattctttgctggatattctttagcgaataatgctgcgtttaatcagtcggattttgattttgtatcatcatatataaaaaaaggatcatctttttatgatgatgtaaagaagcgtgtatctaaaggaagtttaatgatgattagttcaccacaaattatagatgctgaaaaacatggtgataagattaccgcaaccgtaagattaataaatgaaaacggtaagcaagtagataaagaatatgagcttgaacaaggctcgcaagaccgcttgcaattaatcaagacatcagaaaaa

SEQ ID NO: 4404 - protein, 460 aa, Staphylococcus aureus
  MISC_FEATURE (1)..(460): TcaA protein
MKSCPKCGQQAQDDVQICTQCGHKFDSRQALYRKSTDEDIQTNNIKMRKMVPWAIGFFILILIIILFFLLRNFNSPEAQTKILVNAIENNDKQKVATLLSTKDNKVDSEEAKVYINYIKDEVGLKQFVSDLKNTVHKLNKSKTSVASYIQTRSGQNILRVSKNGTRYIFFDNMSFTAPTKQPIVKPKEKTKYEFKSGGKKKMVIAEANKVTPIGNFIPGTYRIPAMKSTENGDFAGHLKFDFRQSNSETVDVTEDFEEANISVTLKGDTKLNDSSKKVTINDHEMAFSSSKTYGPYPQNKDITISASGKAKDKTFTTQTKTIKASDLKYNTEITLNFDSEDIEDYVEKKEKEENSLKNKLIEFFAGYSLANNAAFNQSDFDFVSSYIKKGSSFYDDVKKRVSKGSLMMISSPQIIDAEKHGDKITATVRLINENGKQVDKEYELEQGSQDRLQLIKTSEK

SEQ ID NO: 4405 - DNA, 174 bp, Staphylococcus aureus
ttgaaattcataaccttaactgacaaaggtagagcatatttgaaagaacgtaatgcgattatgacagatattgcgcaagatattactaatgatttaaattctgaagatattgaaaatgtaaggcaagtattagaagtcatcaatcatcgcattaaaacatatagcaatcataaa

SEQ ID NO: 4406 - protein, 58 aa, Staphylococcus aureus
  MISC_FEATURE (1)..(58): TcaR transcription
LKFITLTDKGRAYLKERNAIMTDIAQDITNDLNSEDIENVRQVLEVINHRIKTYSNHK

SEQ ID NO: 4407 - DNA, 234 bp, Staphylococcus aureus
atggtaaaacatttacaagaccatattcaatttttagagcagtttataaataacgttaacgcattaactgcaaaaatgttgaaagatttacaaaatgaatatgaaatttcattagagcagtctaacgtattaggtatgttaaataaagaacctttgacaattagtgaaatcacgcaaagacaaggtgtaaataaggccgcagtaagccgacgaattaaaaagttaatcgatgct

SEQ ID NO: 4408 - protein, 78 aa, Staphylococcus aureus
  MISC_FEATURE (1)..(78): TcaR transcription
MVKHLQDHIQFLEQFINNVNALTAKMLKDLQNEYEISLEQSNVLGMLNKEPLTISEITQRQGVNKAAVSRRIKKLIDA

SEQ ID NO: 4409 - DNA, 966 bp, Staphylococcus aureus
atgttattgaatttattattaatatttatacttatcgttatttgtccgttaattttcaactatactctgacgttaaatttaacatgctacatcttagttgtcatatcgatatttttgtcactcatctatagcatcatgacctatactttcccttggtctatgtttgtaacatttataataatcagtattatcatgctattcaaacatagatatttattttctcatacttctagtcgcttatttattaaaaaattattatctttttcatataaatttgtactctacacatcagcacttctatttataagtacgattcagtcacctattgtgaaaggtttgtctatgtggttagctatattatgtctttccctgttactaacctttatttgttatctcgtttggacagtatcatatagacatagatcatacaacaaagaagttgatatcataattgtgttaggtgctggtatttttaccgaatttgtcacaccaatgcttgcagcgcgtttagatcgtgcacttgatatctatcaacaacaagcatcagcaacaaagatcattgtatctggcggacaaggaccagacgaaccaatttctgaagctttagctatgcaacgttatttgattgcacatggtgttgataaaacagatatactaatggaatctcactctataaatacatacacaaactttttatattctaaacaaatcatcaacaatttgtatcatgaagcagttaaaattgtttgtgtaacaagtcagtttcatgtattgcgcgccttacgactagcccaaaaattaggtttatctatcgatggtgtcggaagtcatacaccatatcactttttcttacatgtgctcatcaaagattatctaggcgtaatgtatcagtatagattgttattaacgttatattgttcaagtagttggtttatatgtctttacgccgcttttatttataatagt

SEQ ID NO: 4410 - protein, 322 aa, Staphylococcus aureus
  MISC_FEATURE (1)..(322): hypothetical protein
MLLNLLLIFILIVICPLIFNYTLTLNLTCYILVVISIFLSLIYSIMTYTFPWSMFVTFIIISIIMLFKHRYLFSHTSSRLFIKKLLSFSYKFVLYTSALLFISTIQSPIVKGLSMWLAILCLSLLLTFICYLVWTVSYRHRSYNKEVDIIIVLGAGIFTEFVTPMLAARLDRALDIYQQQASATKIIVSGGQGPDEPISEALAMQRYLIAHGVDKTDILMESHSINTYTNFLYSKQIINNLYHEAVKIVCVTSQFHVLRALRLAQKLGLSIDGVGSHTPYHFFLHVLIKDYLGVMYQYRLLLTLYCSSSWFICLYAAFIYNS

SEQ ID NO: 4411 - DNA, 354 bp, Staphylococcus aureus
atgattcaaaataccttcggttatttaccggagtatattgtagctgatgcatgttatgatagtgagcaaaactatatggctattatagatgattttaataaaacgccacttattacgtatgtcatgtttattaaagataaaactagaaagtttaaaagtgacatttttaacactcaaaattggaaatatgacgaacttaatgatgaatttatatgtcctaataacaaaagaataggttttaaaagatatgcataccataatgatagatatggttttaaacgtgacttcaagctatatgaatgcaacgagctgtacattataaaatacatatcaaaaaagctgatttctatcaaa

SEQ ID NO: 4412 - protein, 118 aa, Staphylococcus aureus
  MISC_FEATURE (1)..(118): truncated transposase
MIQNTFGYLPEYIVADACYDSEQNYMAIIDDFNKTPLITYVMFIKDKTRKFKSDIFNTQNWKYDELNDEFICPNNKRIGFKRYAYHNDRYGFKRDFKLYECNELYIIKYISKKLISIK

SEQ ID NO: 4413 - DNA, 663 bp, Staphylococcus aureus
atggcattagtcgttgaagatatcgtcaaaaatttcggagaaggtttgtctgaaacaaaagttttaaaaggtattaattttgaagtggaacaaggggaatttgtcattttaaatggtgcctctggttctgggaaaacaacattgctaacgatattaggcggattgttaagtcaaacgagtggtacagtgctttacaatgatgcgccattgtttgataaacagcatcgtcctagtgatttacgattggaagatattggttttatttttcaatcttcacatttagttccttatttaaaagtgatagagcaattgacactcgtaggtcaagaagcgggaatgaccaaacaacaaagttcaacaagagcaatacaacttttgaaaaatattggtttagaagatcgcttgaatgtatatccgcatcagttatctggcggtgaaaagcaacgtgttgcgattatgagagcatttatgaataatccgaaaatcattttagcagatgagcccacagcaagtttagatgccgatagagcaacaaaagttgttgagatgatacgtcaacaaattaaagaacaacaaatgattggtattatgattacacacgatcgaagattatttgaatatgcagatcgagtgattgaattagaagatggcaaaataactgat

SEQ ID NO: 4414 - protein, 221 aa, Staphylococcus aureus
  MISC_FEATURE (1)..(221): hypothetical protein
MALVVEDIVKNFGEGLSETKVLKGINFEVEQGEFVILNGASGSGKTTLLTILGGLLSQTSGTVLYNDAPLFDKQHRPSDLRLEDIGFIFQSSHLVPYLKVIEQLTLVGQEAGMTKQQSSTRAIQLLKNIGLEDRLNVYPHQLSGGEKQRVAIMRAFMNNPKIILADEPTASLDADRATKVVEMIRQQIKEQQMIGIMITHDRRLFEYADRVIELEDGKITD

SEQ ID NO: 4415 - DNA, 972 bp, Staphylococcus aureus
atggtgttatttattagtggtttagctcaagggcttggtagggagaatatttcgttatttgaacactttgataatgatgaatatgttgttcaaaaaatgaaagagccgcaaattgagaaatcgcaacttagtgatacgcaacagaatcaaattaaaaaggtaattcatcaagaaccatataaaatgaatattcaaacattgaaattatctaataaagaacaagatgtgattacaatgaatgacgttaaacaacaacgcatacaacttaaaaaaggtgattatcctaaaaatgctcatgaggtcgctattaatgataagttagctgcagacaacattagagtcggggatagattacattttaaaaataattcaactagttatagagtttctggtattttaaacgacacaatgtatgcgcatagttccattgtgctattgaacgataacggatttaatgcattgaataaggttaatacggcattttatccagtgaaaaatttaacacaacaacaacgtgatgagcttaataaaataaatgacgttcaagttgtgagtgaaaaagatttaacaggtaatattgcgagttatcaagcagagcaagcaccgttaaatatgatgattgttagtttgtttgctattacagcaatcgttctaagtgcatttttctatgttatgacgattcaaaaaatatcacaaattggcattttgaaagcaattggtattaagacaagacatttattgagtgcgttagttttacaaattttaacactaacaataattggggtaggtattgctgtgatcatcatagtaggactatcatttatgatgccggtaacgatgcctttttacttaacaacgcaaaatattttattaatggtggggatatttatattagtagcgattttaggtgcctcactatcatttatcaaattatttaaagtggatcctatcgaagcaattggaggtgcagaa

SEQ ID NO: 4416 - protein, 324 aa, Staphylococcus aureus
  MISC_FEATURE (1)..(324): conserved hypothetical
MVLFISGLAQGLGRENISLFEHFDNDEYVVQKMKEPQIEKSQLSDTQQNQIKKVIHQEPYKMNIQTLKLSNKEQDVITMNDVKQQRIQLKKGDYPKNAHEVAINDKLAADNIRVGDRLHFKNNSTSYRVSGILNDTMYAHSSIVLLNDNGFNALNKVNTAFYPVKNLTQQQRDELNKINDVQVVSEKDLTGNIASYQAEQAPLNMMIVSLFAITAIVLSAFFYVMTIQKISQIGILKAIGIKTRHLLSALVLQILTLTIIGVGIAVIIIVGLSFMMPVTMPFYLTTQNILLMVGIFILVAILGASLSFIKLFKVDPIEAIGGAE

SEQ ID NO: 4417 - DNA, 105 bp, Staphylococcus aureus
gtgaatcgatatgaaattagcgataaaagagattatgttttacaaatttcgttatattttaatcacattaatcattcttttattaagtattatggtgttatttat

SEQ ID NO: 4418 - protein, 35 aa, Staphylococcus aureus
VNRYEISDKRDYVLQISLYFNHINHSFIKYYGVIY

SEQ ID NO: 4419 - DNA, 699 bp, Staphylococcus aureus
atgaaaaagataagggagtttatagctatggtgcaatgtcttgttgtcgatgacgatcctcgaatcctaaattatatagctagccatttacaaacagagcacattgatgcatacacacaaccaagtggtgaagctgcattaaaacttttagaaaaacagcgtgtcgatattgcagtggtagatattatgatggatggtatggacggctttcaattatgtaatacattaaaaaatgattatgatataccagttattatgttaacagcgcgggatgcacttagtgacaaagagcgtgcgtttataagcggtactgacgattatgtaaccaaaccctttgaggttaaggaacttatttttagaattcgtgctgtattacgtcgatataatatcaattcaaattcagaaatgactattggcaacttaacgctaaaccaatcctatttggaactccaagtatctaataaaacgatgacgttaccgaacaaggaatttcaattattatttatgcttgcagcacgtcctaagcaaatctttactcgtgaacaaataatagaaaaaatttggggctatgattatgaaggagatgagcgaacagttgacgttcatattaagcgactacgccaaagattaaaaaaattaaatgccacacttacaattgaaacagtaagaggacaaggctataaggtggagaatcatgtt

SEQ ID NO: 4420 - protein, 233 aa, Staphylococcus aureus
  MISC_FEATURE (1)..(233): hypothetical protein
MKKIREFIAMVQCLVVDDDPRILNYIASHLQTEHIDAYTQPSGEAALKLLEKQRVDIAVVDIMMDGMDGFQLCNTLKNDYDIPVIMLTARDALSDKERAFISGTDDYVTKPFEVKELIFRIRAVLRRYNINSNSEMTIGNLTLNQSYLELQVSNKTMTLPNKEFQLLFMLAARPKQIFTREQIIEKIWGYDYEGDERTVDVHIKRLRQRLKKLNATLTIETVRGQGYKVENHV

SEQ ID NO: 4421 - DNA, 327 bp, Staphylococcus aureus
atgtatcaactacaatttataaatttagtttacgacacaaccaaactcacacatctagaacaaaccaatatcaatttattcattggtaattggagtaatcatcaattacaaaaatcaatttgtatacgtcatggcgatgatacaagtcacaatcaatatcatattctttttatagatacggcacatcaacgcattaaattttcatctattgataatgaagaaatcatttatattcttgattatgatgatacacagcatatcctcatgcaaacgtcatccaaacaaggtattggcacttcgcgaccaatcgtttatgagcgcttagta

SEQ ID NO: 4422 - protein, 109 aa, Staphylococcus aureus
  MISC_FEATURE (1)..(109): cysteine protease
MYQLQFINLVYDTTKLTHLEQTNINLFIGNWSNHQLQKSICIRHGDDTSHNQYHILFIDTAHQRIKFSSIDNEEIIYILDYDDTQHILMQTSSKQGIGTSRPIVYERLV

SEQ ID NO: 4423 - DNA, 1371 bp, Staphylococcus aureus
atgtttaaaacactctatgctagaattgcgatttattccattacggttattttatttagtgcattaataagttttgtattaacaaatgtttactatcattataatttaaaagcatctaatgacgcgaaaatcatgaagacgcttaaagaagcaagacaatatgaacaatcagctaaaccaacgcacattcaacaatatttcaaacatttagggcaaatgaattaccaaataatgaccattgatcaaaaaggtcataagacattttatggggagccatttagagaagatactttatcacaaaatgctattaacaacgtattaaataatcaagattaccatggtattaaagataaaccattcgcattattcgtaactggatttttcgacaatgtaacagataatactgttggtattaactttaagacaaaagacggttcaatagcagtatttatgcgtccagatattggagaaacatttagcgagtttagaacattcttagccgtcttgttaatgttgttattatttatctcgatttcattagttatcgcatcaacctattcaatcattcgtccagtaaaaaagttaaagctagcgaccgaacgcttaattgatggtgattttgaaacacctatcaaacaaacacgcaaagatgaaattggaacattacagtatcactttaataagatgagagagtcattgggacaagttgatcaaatgaggcagcattttgtacaaaatgtatctcatgaaatcaaaacaccattaacacatattcatcatttattaagcgagttacaacaaacttctgataaaacattaagacaacaatatataaatgatatctataccattacaacgcagctgagcggattaacaactgaattgttgctcttatccgaattagataatcaccaacatttattattcgatgataagattcaagtcaatcaactcattaaagatatcattcgacatgaacaatttgctgctgatgaaaagtcgttaatcattttagctgacctagaatcaatcaatttcctaggaaatcaacgtttgttacatcaagcattgagtaatttattaataaatgctattaagtatacagatgttggtggtgccattgacatcgctttgcaacatagtcacaacaatatcattttcacaataagtaatgatggttcaccaattagtccacaagctgaagcacgtttatttgaacgtttttataaagtgagcaaacatgataatagcaatggtttaggtcttgcaattacaaaatccatcattgaattgcatcatggtacaatccaattcacacaaagtaacgagtatgtaaccacctttactattacactgccaaataattcactt

SEQ ID NO: 4424 - protein, 457 aa, Staphylococcus aureus
  MISC_FEATURE (1)..(457): hypothetical protein
MFKTLYARIAIYSITVILFSALISFVLTNVYYHYNLKASNDAKIMKTLKEARQYEQSAKPTHIQQYFKHLGQMNYQIMTIDQKGHKTFYGEPFREDTLSQNAINNVLNNQDYHGIKDKPFALFVTGFFDNVTDNTVGINFKTKDGSIAVFMRPDIGETFSEFRTFLAVLLMLLLFISISLVIASTYSIIRPVKKLKLATERLIDGDFETPIKQTRKDEIGTLQYHFNKMRESLGQVDQMRQHFVQNVSHEIKTPLTHIHHLLSELQQTSDKTLRQQYINDIYTITTQLSGLTTELLLLSELDNHQHLLFDDKIQVNQLIKDIIRHEQFAADEKSLIILADLESINFLGNQRLLHQALSNLLINAIKYTDVGGAIDIALQHSHNNIIFTISNDGSPISPQAEARLFERFYKVSKHDNSNGLGLAITKSIIELHHGTIQFTQSNEYVTTFTITLPNNSL

SEQ ID NO: 4425 - DNA, 441 bp, Staphylococcus aureus
atgatgaaactcaatttatttatcaatgcaaatgagacggaatcttatattgatatacatgcacctaaaatgaatgataacgttcaaagtattattaatgcagtcaatgatttagacaaatcacatacattagtcggatacatagacaaagaaatccatatcattaatgtatcagatgttataacattccaagttattaataaaaatgtaacagccattacaagcaatcaaaaattcaaactaaaattacgactttatgaactagaaaaacagttaccacaacatttcattcgcatttccaaatcagaaatcgtcaacaagtattacattgaaaaattattattagagccaaatggacttatacgtatgtatcttaaagatgcacactacacctattcttctagacgttatttaaaatctataaaggagcgcttatcaata

SEQ ID NO: 4426 - protein, 147 aa, Staphylococcus aureus
  MISC_FEATURE (1)..(147): conserved hypothetical
MMKLNLFINANETESYIDIHAPKMNDNVQSIINAVNDLDKSHTLVGYIDKEIHIINVSDVITFQVINKNVTAITSNQKFKLKLRLYELEKQLPQHFIRISKSEIVNKYYIEKLLLEPNGLIRMYLKDAHYTYSSRRYLKSIKERLSI

SEQ ID NO: 4427 - DNA, 453 bp, Staphylococcus aureus
atgaaaaatttgaaaaactcattatttattagcttaatcattggtttgtccctttcactgttctttagtatgttatttgcagacggcaaatattatccactgaacccacaatcaactattggcatattgtattatacgcatttcacagaaactaccgtaatgttgatttctatcattttatggttactcataggcgtcgtctttttccttggagattttatctttaaatacacagattggagcattactaaagcaactataatgcatttcataacaacgtatgtcggattcttgcctttagcaatgcttgccggttggtttccactaacagtgcattatctaatcatattcacaattatcttcattgtggtttatgtattaatttggataattcaattctttaaaaacaagaactacgtagacactattaacaagcaactgaaacaattaaaa

SEQ ID NO: 4428 - protein, 151 aa, Staphylococcus aureus
  MISC_FEATURE (1)..(151): hypothetical protein
MKNLKNSLFISLIIGLSLSLFFSMLFADGKYYPLNPQSTIGILYYTHFTETTVMLISIILWLLIGVVFFLGDFIFKYTDWSITKATIMHFITTYVGFLPLAMLAGWFPLTVHYLIIFTIIFIVVYVLIWIIQFFKNKNYVDTINKQLKQLK

SEQ ID NO: 4429 - DNA, 1533 bp, Staphylococcus aureus
atgtcgtatttctcgaacgttccattattcattttaaaaagggggactgtatttgttatgacaacacaacatagcaaaacagatgtcatcttaattggtggcggtattatgagtgcaacattaggaacattacttaaagaattatcacctgagaaaaatattaaagtgtttgaaaaattagcacaacctggcgaagagagttcaaatgtatggaataatgccggtacagggcattcagcactttgcgagttgaactatacaaaagaaggtaaggatggcacagttgattgtagtaaagcaattaagataaatgagcagtaccaaatttcaaaacagttttgggcatatttagttaaaacaggacaattagataacccagatcgctttattcaagcggtgccacacatgagttttgtcattggcgaagataatgtagcttttataaaaagtcgtgttgcaacgttaaagaaaagtattttattcgaaaaaatgaaattatcgcaagatgaagaagaaatgaaatcttgggtaccgttaatgattgaaggtcgtaagtctgatgaaccaattgctttaacttatgatgaaactggtacagatgttaactttggtgcgttaactgcaaagttatttgataatttagagcaacgtggtgtgggaattcaatataagcagaatgtattagacatcaagaaacagaaatctggggtatggctagttaaagttaaagatttagaaactaatgaaacgacaacatatgaatctgattttgtatttattggtgctggcggtgcgagtttaccattactccaaaagactgggattaaacaatcaaaacatattggtggtttcccggtaagtggattattcctgcgctgtacaaatcaagaagtgattgatcgtcatcatgctaaagtgtacggaaaagcagcagtgggtgcgccaccaatgtcagtgccgcacttagatacacgttttgtagacggcaagcgttcattgttatttggtccatttgcaggtttctcacctaaatttttaaaaacaggttcacatatggatttaattaaatcggttaaaccaaataatatcgtgacgatgttatctgcaggtatcaaagaaatgagtcttacgaagtatttagtgtcacaattgatgttatctaatgatgagcgtatggatgatttaagagtctttttcccaaatgctaaaaatgaagattgggaagtgattacagcagggcaacgtgtccaagtaatcaaggatactgaggattctaaaggtaacttacaatttggtactgaagttattacgtcagatgatggcacattagctgcattacttggtgcatcacctggtgcgtcaacagctgtagatattatgtttgatgttttacagagatgctatcgtgatgaattcaaaggatgggaaccaaagattaaagaaatggtgccgtcatttggttatcgcttaacagatcatgaggatttatatcataaaattaatgaagaagtaactaagtatttacaagttaaa

SEQ ID NO: 4430 - protein, 511 aa, Staphylococcus aureus
  MISC_FEATURE (1)..(511): hypothetical protein
MSYFSNVPLFILKRGTVFVMTTQHSKTDVILIGGGIMSATLGTLLKELSPEKNIKVFEKLAQPGEESSNVWNNAGTGHSALCELNYTKEGKDGTVDCSKAIKINEQYQISKQFWAYLVKTGQLDNPDRFIQAVPHMSFVIGEDNVAFIKSRVATLKKSILFEKMKLSQDEEEMKSWVPLMIEGRKSDEPIALTYDETGTDVNFGALTAKLFDNLEQRGVGIQYKQNVLDIKKQKSGVWLVKVKDLETNETTTYESDFVFIGAGGASLPLLQKTGIKQSKHIGGFPVSGLFLRCTNQEVIDRHHAKVYGKAAVGAPPMSVPHLDTRFVDGKRSLLFGPFAGFSPKFLKTGSHMDLIKSVKPNNIVTMLSAGIKEMSLTKYLVSQLMLSNDERMDDLRVFFPNAKNEDWEVITAGQRVQVIKDTEDSKGNLQFGTEVITSDDGTLAALLGASPGASTAVDIMFDVLQRCYRDEFKGWEPKIKEMVPSFGYRLTDHEDLYHKINEEVTKYLQVK

SEQ ID NO: 4431 - DNA, 1596 bp, Staphylococcus aureus
atgttagtaaatacgtttaacccatttgataatttattattatcgtctttaattgcagcaataccgattgtactgtttttactatgtttaactgtttttaaaatgaaaggtatttatgcagctattacaacacttgttgtaacattactaattgcaataccatttttcaaattgccagttggtatcgcttctggtgcagtagtcgaaggtttcttccaaggtatcattccgattggctatatcgttatgatggcagtattgttatacaaaattactgttgaatctggacaatttttaacaattcaagatagtattacaaatatttcacaagaccaacgtattcaagttttacttattggatttgcattcaacgcatttttagaaggtgcagcaggatttggtgtaccaattgcaatttgtgcacttttattaacacaattaggatttaatccattaaaagctgcgatgttatgtttagtcgcaaatgcagcgtctggtgcttttggtgcgattggtatccctgtaggtgttgtagaaacgttgaaattacctggagatgtttcagtattaggtgtttctcaatcagcaactttaacattggcaatcataaatttcattattccattcttacttatctttattattgatggttttagaggtgttaaagaaacattaccagcaattttagtagtttcaatcacttatacacttactcaaggattattaactgtattcagtggacctgaattagcagatattattccaccgttattaacaatgttagcattagcagtattttctaaaaaattccaaccaaaacacatttatcgtgttaataaagatgaagaaattgaacctgcaaaagcacattctgcaaaagcagtattacatgcatggagcccattcattgtattaacagtcattgtaatgatttggagtgcgccattctttaaaaacttattcttaccaaatggtgctttatcatcattagtatttaaattcaacttacctggaacaatcagcgaagttacgcataaaccattagtattgactttaaatattattggacaaacaggtacagctattttattaactattattattacaattttaatgtctaaaaaggttaactttaaagatgcaggtagattattcggcgttacatttaaagagttgtggttaccagttcttacaatttgtttcatcttagcaatttctaaaatcacaacttatggtggtttaagtgcagcaatgggtcaaggtattgctaaagcaggtaatgtcttcccagttctatcaccaattttaggttggataggtgtgtttatgacaggatcagttgtaaataacaactcattatttgcaccaattcaagcttctgttgcacaacaaattggaacaagtggttcacttcttgtatctgctaatacagttggtggtgtagcggcaaaattgatttcaccacaatcaattgcaattgcaactgcagcagtaaaacaagttggtaaggaatcagaattattaaaaatgacattgaaatacagtgtatgtttactaatattcatctgtatttggactttcatcttgtcattatta

SEQ ID NO: 4432 - protein, 532 aa, Staphylococcus aureus
  MISC_FEATURE (1)..(532): L-lactate permease lctP
MLVNTFNPFDNLLLSSLIAAIPIVLFLLCLTVFKMKGIYAAITTLVVTLLIAIPFFKLPVGIASGAVVEGFFQGIIPIGYIVMMAVLLYKITVESGQFLTIQDSITNISQDQRIQVLLIGFAFNAFLEGAAGFGVPIAICALLLTQLGFNPLKAAMLCLVANAASGAFGAIGIPVGVVETLKLPGDVSVLGVSQSATLTLAIINFIIPFLLIFIIDGFRGVKETLPAILVVSITYTLTQGLLTVFSGPELADIIPPLLTMLALAVFSKKFQPKHIYRVNKDEEIEPAKAHSAKAVLHAWSPFIVLTVIVMIWSAPFFKNLFLPNGALSSLVFKFNLPGTISEVTHKPLVLTLNIIGQTGTAILLTIIITILMSKKVNFKDAGRLFGVTFKELWLPVLTICFILAISKITTYGGLSAAMGQGIAKAGNVFPVLSPILGWIGVFMTGSVVNNNSLFAPIQASVAQQIGTSGSLLVSANTVGGVAAKLISPQSIAIATAAVKQVGKESELLKMTLKYSVCLLIFICIWTFILSLL

SEQ ID NO: 4433 - DNA, 1686 bp, Staphylococcus aureus
atggaagttatagcaatgattaaacagataaatgtttctaatatgcaaaagtttgaatctcaattaatgaaagctcagtctgaaggttatacacatgtcgttccatatgccaatgagataatgatttatcaatcgatgttagatgcggttcaattatatcctaagtctatcgtggttgattatactgtggatggacaatacaaaaatgattgtcactatttcggtcaatcatcgatcaacattgccgattgggctcaaaacaataattattatcctaacctgatatatgcgattcaacagactcttgatttaatacattattactctgtagaaacgattttcgatttagctttattgacacttctgaaaggtgatttatcaatcgatggtcatgtcgtttttgattttaaagcccctatagcaacaagtgcttcaatatgggaaactattaaaactattgaagattttgatatgatgtctcagttttatttgaataaaatggcttatattgatcatcatcctataccttttcgcaacctttttatcgaggattcagaacaacttaattcgccagataattggttgtattctaccaagtttatgctacctaaatggttatataaaatagcaaagcaacgtgctgataacaaacaattacaaaacttcggcctgtatacgaagcaaccaaacgttttaaaagatcacatcgtttttatcggtgatcatcatcaatatataggtaattcaaaatatttatttacttacttcgttaaacataatccaatgactgcctgttattttgttactgacgatcgtcgcggaccacatttcatatcacctaagtctgaaaaagctgacgaattgattaacagcgcacgcgtagttatagttgaaaatgatatacctgaaacgttacaaccaaacggtactttaattcaattacatcaaggcacaccaataatgcaattatttttagatagtaaagagcctattaaaaatatagaaacacctttttatcgtgctaaaaggtataatcgctggttgcaattcgattatgttatacattctgctgatgatattagccacttttatcaaacggcttttcctagtcaccaagcaaatgtattggcttatggtaatcctaaacaccaatatttactacaaaagagtaacgaaagtactactcaacaacagtataagaaatcgtttaaaataaatgatcaaaaaccagttttattatacgcacctattggattagtgagtgcgcaacaattaccactatcagatgctttattcaaagcctatcatgttgtggttcagggtgttgatgaagcgatcttaccagaagaggcgcttgttgcaccaaagtatcttagtgctcaagacttaattctaatgtctgatgtcgttatcactgattactcaaatataatatttgatgcgatggctatagacaaaacagtagcattatacactccaaatcacagtcaatacattgagtctcaaggtgttaacgaagatatttggcgtcatctatcaaaaatttggtatacagaccgacaattattaattaataatttaatttcccaggcaataccagtgattaaatatccacaaatacaacataaagaacaaccattagaatctatttcacaacttatattgtctaagatgacatctaatcaa

SEQ ID NO: 4434 - protein, 562 aa, Staphylococcus aureus
  MISC_FEATURE (1)..(562): hypothetical protein
MEVIAMIKQINVSNMQKFESQLMKAQSEGYTHVVPYANEIMIYQSMLDAVQLYPKSIVVDYTVDGQYKNDCHYFGQSSINIADWAQNNNYYPNLIYAIQQTLDLIHYYSVETIFDLALLTLLKGDLSIDGHVVFDFKAPIATSASIWETIKTIEDFDMMSQFYLNKMAYIDHHPIPFRNLFIEDSEQLNSPDNWLYSTKFMLPKWLYKIAKQRADNKQLQNFGLYTKQPNVLKDHIVFIGDHHQYIGNSKYLFTYFVKHNPMTACYFVTDDRRGPHFISPKSEKADELINSARVVIVENDIPETLQPNGTLIQLHQGTPIMQLFLDSKEPIKNIETPFYRAKRYNRWLQFDYVIHSADDISHFYQTAFPSHQANVLAYGNPKHQYLLQKSNESTTQQQYKKSFKINDQKPVLLYAPIGLVSAQQLPLSDALFKAYHVVVQGVDEAILPEEALVAPKYLSAQDLILMSDVVITDYSNIIFDAMAIDKTVALYTPNHSQYIESQGVNEDIWRHLSKIWYTDRQLLINNLISQAIPVIKYPQIQHKEQPLESISQLILSKMTSNQ

SEQ ID NO: 4435 - DNA, 627 bp, Staphylococcus aureus
atgaaaagattagttacagggttactagcattatcattatttttagctgcatgtggtcaagatagtgaccaacaaaaagacggtaataaagaaaaagatgataaagcgaaaactgaacaacaagataaaaaaacaaatgattcatctaaagataagaaagataataaagatgatagtaaagacgtaaacaaagataataaagataatagtgcaaacgataaccagcaacaatctaattcaaatgcaacaaacaatgaccaaaaccaaacaaataataaccaatcaagtaataaccaagcgaataataatcaaaaatcaagttacgttgcaccatattatggacaaaatgccgcgccggttgcacgtcaaatttatccgtttaatggaaataaaaatcaagctttacagcaattgccaaatttccaaacagctttaaatgcggctaataatgaagcaaataaatttggtagtaataataaagtgtataatgattattctattgaagaacataatggcaactataagtatgtgtttagttttaaagacccaaatgcaaatggaaaatattcaattgtaacggttgattatactggacaagcaatggttactgatccaaactaccaacaa

SEQ ID NO: 4436 - protein, 209 aa, Staphylococcus aureus
  MISC_FEATURE (1)..(209): hypothetical protein
MKRLVTGLLALSLFLAACGQDSDQQKDGNKEKDDKAKTEQQDKKTNDSSKDKKDNKDDSKDVNKDNKDNSANDNQQQSNSNATNNDQNQTNNNQSSNNQANNNQKSSYVAPYYGQNAAPVARQIYPFNGNKNQALQQLPNFQTALNAANNEANKFGSNNKVYNDYSIEEHNGNYKYVFSFKDPNANGKYSIVTVDYTGQAMVTDPNYQQ

SEQ ID NO: 4437 - DNA, 513 bp, Staphylococcus aureus
atggctgggataatcaaagaaatttcagaacaaaatgctagtgaattagttgaattagcaactagaacattttatgacacgtttggttcttactatgatgacaaagattttgatcaattttttaaagacaattatactgtagagaaatttacacaagagattaaccatgtagattcatttcattatttttatcaagaagatggtgcgaatgttggttatataaagatgaatattaatagtgctcaaactgaagaaatgggggagacctatttagaagtgcagcgcatatattttttgaaagactttcaaggtggcggaagaggttcacaattgatagaattggccgaaaaaattgctcaagaacataataaacataaaatttggctaggagtttgggagcataatcctcgtgctcaagcattttataaacgtcatggatttaaagtggttggtgaacatcattttcaaacaggtgatgtaacggatacagatttaattatggaaaaagagtta

SEQ ID NO: 4438 - protein, 171 aa, Staphylococcus aureus
  MISC_FEATURE (1)..(171): hypothetical protein
MAGIIKEISEQNASELVELATRTFYDTFGSYYDDKDFDQFFKDNYTVEKFTQEINHVDSFHYFYQEDGANVGYIKMNINSAQTEEMGETYLEVQRIYFLKDFQGGGRGSQLIELAEKIAQEHNKHKIWLGVWEHNPRAQAFYKRHGFKVVGEHHFQTGDVTDTDLIMEKEL

SEQ ID NO: 4439 - DNA, 1044 bp, Staphylococcus aureus
atggccgtattttcaaaagagaaaaagagaggatgtatcgttgtgatagaaacatttaaagcgtttgtaattgataaagatgagagtggtaaagtgacaccaactttcaaacaattatcgcctactgatttacctaaaggagatgtgctgattaaagtacattactctggtataaattataaagatgctttagcgactcaagatcataatgcagtcgtaaaatcgtatcctatgattccaggaatagatttagctggaacaattgttgaatccgaagcaccaggctttgaaaaaggagaacaagtaattgtaacgagttatgacctaggtgtcagccattatggcggttttagtgaatatgcgcgtgtaaaatcagaatggattatcaagcttcctgatactttaacattagaagaatcaatgatatatggcacagctggttatactgccggtttagcaattgaaagacttgaaaaagttggaatgaatattgaagatggtcctgtactcgttcgcggtgcttcaggtggtgtcggtactttagcagtactcatgcttaatgaacttggttataaagttatcgcaagtacaggtaaacaagatgttagcgatcaattacttgaacttggtgccaaagaagttatcgatcgacttcctgttgaagatgatcataaaaagccactcgcatcatcaacttggcaagcttgtgtagaccctgttggtggcgaaggtattaattatgttacaaagcgtttaaatcatagtgggtcaattacagttattggtatgactgccggtaatacttatactaattctgtattccctcacattttaagaggtgtaaacattttaggaattgactcggtatttactgctatgaaattaagacagcgcgtttggcgtcgtctcgcaaaagatttaatgcctgaaaatttacatgagatcaagcaagttattacatttgatgaacttccagaacaacttaacaaagtaattaaacatgaaaataaagggcgcattgttatcgatttcggtgtagataaa

SEQ ID NO: 4440 - protein, 348 aa, Staphylococcus aureus
  MISC_FEATURE (1)..(348): conserved hypothetical
MAVFSKEKKRGCIVVIETFKAFVIDKDESGKVTPTFKQLSPTDLPKGDVLIKVHYSGINYKDALATQDHNAVVKSYPMIPGIDLAGTIVESEAPGFEKGEQVIVTSYDLGVSHYGGFSEYARVKSEWIIKLPDTLTLEESMIYGTAGYTAGLAIERLEKVGMNIEDGPVLVRGASGGVGTLAVLMLNELGYKVIASTGKQDVSDQLLELGAKEVIDRLPVEDDHKKPLASSTWQACVDPVGGEGINYVTKRLNHSGSITVIGMTAGNTYTNSVFPHILRGVNILGIDSVFTAMKLRQRVWRRLAKDLMPENLHEIKQVITFDELPEQLNKVIKHENKGRIVIDFGVDK

SEQ ID NO: 4441 - DNA, 399 bp, Staphylococcus aureus
atggttaaagtgacatatgatattccgacttgcgaggattattgcgcattaaggattaacgcaggtatgagtccaaagacgcgcgaagcagctgaaaaaggattacctaatgccttatttacagtaaccttgtatgataaagatcggttaattggtatgggtagagtgattggcgatggcggaactgtttttcaaattgttgatattgcagttttgaaaagttaccaaggtcaaggttacggcagtctaattatggagcatattatgcaatatattaaaggtgtggctgttgagagtacatacgttagtctgattgcagactacccagcggataaattatatacaaaatttggatttatacctaccgaaccagattcaggcggtatgtatatcaaatac

SEQ ID NO: 4442 - protein, 133 aa, Staphylococcus aureus
  MISC_FEATURE (1)..(133): hypothetical protein
MVKVTYDIPTCEDYCALRINAGMSPKTREAAEKGLPNALFTVTLYDKDRLIGMGRVIGDGGTVFQIVDIAVLKSYQGQGYGSLIMEHIMQYIKGVAVESTYVSLIADYPADKLYTKFGFIPTEPDSGGMYIKY

SEQ ID NO: 4443 - DNA, 1179 bp, Staphylococcus aureus
atgaatagttcatgtaaatctagagtattcaatattataagcatcataatggtttcaatgcttattttatcactaggcgcatttgctaataacaataaagccaaagccgattcacactctaaacagctagaaattaatgttaagagtgacaaagtacctcaaaaagtaaaagatctagcacaacaacaatttgctggttatgctaaagcattagataaacaaagtaatgcaaaaactggtaaatatgaacttggcgaagcttttaaaatttataaatttaatggtgaagaagataatagttactattatccagttataaaagacggtaaaattgtttatactttaacacttagtcctaaaaataaagatgatttaaacaaatcaaaagaagacatgaattacagtgttaaaatttcaaacttcatcgctaaagatttagaccaaattaaagataaaaattcaaatatcactgttcttactgatgaaaaagggttttattttgaagaagatggcaaagttagattagtaaaagctacgcctctacctggtaatgtaaaagaaaaagaaagtgctaaaacagtttcagcaaaattgaaacaagagttaaaaaatacagtaacacctactaaagttgaagaaaacgaagcgatacaagaagatcaagttcaatatgaaaatacattaaaaaacttcaaaattagagaacaacaattcgataactcatggtgtgcaggattcagtatggcagcattattaaatgcaactaaaaatacagacacttataatgcacatgatattatgcgtacattataccctgaagtaagtgagcaagaccttcctaattgtgcaacattccctaatcaaatgattgaatacggtaaatcacaaggcagagatattcattatcaagaaggcgtaccatcatatgaacaagttgatcaacttacaaaagataatgtaggaattatgatccttgcacaaagtgtatctcaaaaccctaatgacccacatttaggacatgcgctagcagttgttggtaatgctaaaattaatgaccaagaaaaacttatttactggaatccttgggatacagaattatcaatccaagatgcagattcaagcctattacatttatcattcaatcgtgattataactggtatggttcaatgataggttac

SEQ ID NO: 4444 - protein, 393 aa, Staphylococcus aureus
  MISC_FEATURE (1)..(393): cysteine protease precursor
MNSSCKSRVFNIISIIMVSMLILSLGAFANNNKAKADSHSKQLEINVKSDKVPQKVKDLAQQQFAGYAKALDKQSNAKTGKYELGEAFKIYKFNGEEDNSYYYPVIKDGKIVYTLTLSPKNKDDLNKSKEDMNYSVKISNFIAKDLDQIKDKNSNITVLTDEKGFYFEEDGKVRLVKATPLPGNVKEKESAKTVSAKLKQELKNTVTPTKVEENEAIQEDQVQYENTLKNFKIREQQFDNSWCAGFSMAALLNATKNTDTYNAHDIMRTLYPEVSEQDLPNCATFPNQMIEYGKSQGRDIHYQEGVPSYEQVDQLTKDNVGIMILAQSVSQNPNDPHLGHALAVVGNAKINDQEKLIYWNPWDTELSIQDADSSLLHLSFNRDYNWYGSMIGY

SEQ ID NO: 4445 - DNA, 1071 bp, Staphylococcus aureus
atgaaagaaatgaatatagagagtcataggaggcacataatgaaagatgttacaatcattggtggcggtccgtctggtttgtatgcaagcttttatgctggattgcgagatatgtctgtaagattgatagatgttcaatctgaattagggggtaagatgagaatttaccctgaaaaaattatttgggatattggcggcattgcgccaaaaccttgtcatgaaattttaaaagatacaattaagcaaggattatattttaaaccggaagttcatttgaatgaacgtgtggtagatattaggaaaaaggcagaacgtcatttcgaagttgaaacagaagcgggagaaatatatacatcgaaagcagttatcattgcaattggtgcgggtattattaatccaaaacaattagatgttaaaggtgtagagagatatcaattaactaatttacattatgttgtacaaagttacagacgtttcaaagataaagatgtattaatatcaggtggaggaaatacagcattagattgggcgcatgatattgccaagattgctaaaagcgtgacagttgtttatcgaaaagaagatgtaagtggtcatgaagcgatgaaaacgttggtgacagatttaaatgtgaaactatgcccaaaaacacgtattaaatacttggtcggcaatgatgatgaaacgcatataagtgaagttgttttggaacatgttgaaagtggcgataggcatacagttaaatttgacgatgtcattattagtcatgggtttgatcgttgtaatacattattgagtgaaacatcttcaaagctagatatgcatgatgattgtcgtgttaaaggatttggtaatacgacaactagtatacctggtatctatgcgtgtggagatattgtttatcatgatgcaaaatcacatctaattgcaagtgcatttagtgatggtgcaaatgcagcgaaccttgctaaaacatatatccaaccagatgcgaatgcagagggttatgtttcaagtcatcatgaagtgtttaaagaagcgaataagactattgtaaataaacatttatac

SEQ ID NO: 4446 - protein, 357 aa, Staphylococcus aureus
  MISC_FEATURE (1)..(357): hypothetical protein
MKEMNIESHRRHIMKDVTIIGGGPSGLYASFYAGLRDMSVRLIDVQSELGGKMRIYPEKIIWDIGGIAPKPCHEILKDTIKQGLYFKPEVHLNERVVDIRKKAERHFEVETEAGEIYTSKAVIIAIGAGIINPKQLDVKGVERYQLTNLHYVVQSYRRFKDKDVLISGGGNTALDWAHDIAKIAKSVTVVYRKEDVSGHEAMKTLVTDLNVKLCPKTRIKYLVGNDDETHISEVVLEHVESGDRHTVKFDDVIISHGFDRCNTLLSETSSKLDMHDDCRVKGFGNTTTSIPGIYACGDIVYHDAKSHLIASAFSDGANAANLAKTYIQPDANAEGYVSSHHEVFKEANKTIVNKHLY

SEQ ID NO: 4447 - DNA, 114 bp, Staphylococcus aureus
atggctaactatgcgatttattttaacaatataaatattaatagtataatggctttaaatgataataattatcaatttgagcacgttaatgaaagaaatgaatatagagagtca

SEQ ID NO: 4448 - protein, 38 aa, Staphylococcus aureus
MANYAIYFNNININSIMALNDNNYQFEHVNERNEYRES

SEQ ID NO: 4449 - DNA, 429 bp, Staphylococcus aureus
atgcgtaggttattatattcatttcttttttatatgatcataggtttatttagtggctttttctatagagagctaacaaaagcatatgattttactggtacaacacaattatcacttgtacacacacatacacttattttaggtatgtttatgtttttaatattattaccattggagaagttatttaaattatcaagttactacttatttaactggttcttctatgtatataacataggtgttatcgttactataggtatgatggtgacaaaaggattcttccaagtcactggtaaatcatactctccagaagcatttgcaggctttgcaggtattgggcacacaggtatgcttgcaggtttattgttgctatttttccttttaagacaagcaattcttaaagaaccacgtgatgagtcttttaaaaaa

SEQ ID NO: 4450 - protein, 143 aa, Staphylococcus aureus
  MISC_FEATURE (1)..(143): hypothetical protein
MRRLLYSFLFYMIIGLFSGFFYRELTKAYDFTGTTQLSLVHTHTLILGMFMFLILLPLEKLFKLSSYYLFNWFFYVYNIGVIVTIGMMVTKGFFQVTGKSYSPEAFAGFAGIGHTGMLAGLLLLFFLLRQAILKEPRDESFKK

SEQ ID NO: 4451 - DNA, 90 bp, Staphylococcus aureus
gtgacaaaaaagcgaagatatgacacaactgaatttggtttagcacatagtatgacagctaaaataactttacatcaagcgctatacaaa

SEQ ID NO: 4452 - protein, 30 aa, Staphylococcus aureus
VTKKRRYDTTEFGLAHSMTAKITLHQALYK

SEQ ID NO: 4453 - DNA, 1302 bp, Staphylococcus aureus
ttgtctaataaggaggtaattaataaaatgaatatatttaaaaataaattattatggattgcaccaatagcaactatgattatcttggtaatcttttctttagctttttatcctgcatataatcctaaaccaaaagatttaccaattggtatattaaacgaggataaaggtacaacgattcaagataaaaatgttaacattggtaaaaaattagaggataaattattagatagtgattctaataaaattaaatgggttaaggttgatagtgaaaaagaccttgaaaaagatttgaaagatcaaaaaatctttggagtagctattattgataaagacttttcaaaagatgctatgagtaaaacacaaaaagtagttatggatagtaaaaaagaagaaatgcaacaaaaagttgcttcaggtgaaattccgccacaagtggttcaacaaatgaaacaaaaaatggggaatcaacaagtagaggttaagcaggctaaatttaaaacgattgtaagtgaaggatcaagcttacaaggttcacaaattgcatcagctgtgttaactggtatgggtgataatattaatgctcaaattacgaagcaaagtttggaaacattaacgagtcaaaatgttaaagtcaatgccgcggacatcaatggtttgacgaatccagtaaaagtggataatgaaaaacttaataaagttaaagatcaccaagcaggtggtaatgcaccattcctaatgtttatgccaatttggataggttcaatcgtaacgtctatcttattgttctttgcatttagaactagtaacaatatcgtcgtgcaacatcgtatcattgcttcaattggacagatgatatttgcagttgttgcagcatttgcaggtagctttgtttatatttatttcatgcaaggcgttcaaagatttgattttgaccatccaaatcgtatcgcaatttttgtagcatttgcgattcttggtttcgtgggccttattttaggtgttatggtatggctaggtatgaagtcagttccaattttcttcattttaatgttctttagtatgcaacttgtaacgttacctaaacaaatgttgcctgaaagttatcaaaaatatgtatatgattggaatccattcacacactatgcaacaagtgtaagagaactattatacttgaatcatcatattgaattaaatagtacaatgtggatgtttatagggtttatgatttttggcgctgtatcaagtttagtttcagctattgttagaaaacatagcacaaaacgtactgaagtgccgtca

SEQ ID NO: 4454 - protein, 434 aa, Staphylococcus aureus
  MISC_FEATURE (1)..(434): hypothetical protein
LSNKEVINKMNIFKNKLLWIAPIATMIILVIFSLAFYPAYNPKPKDLPIGILNEDKGTTIQDKNVNIGKKLEDKLLDSDSNKIKWVKVDSEKDLEKDLKDQKIFGVAIIDKDFSKDAMSKTQKVVMDSKKEEMQQKVASGEIPPQVVQQMKQKMGNQQVEVKQAKFKTIVSEGSSLQGSQIASAVLTGMGDNINAQITKQSLETLTSQNVKVNAADINGLTNPVKVDNEKLNKVKDHQAGGNAPFLMFMPIWIGSIVTSILLFFAFRTSNNIVVQHRIIASIGQMIFAVVAAFAGSFVYIYFMQGVQRFDFDHPNRIAIFVAFAILGFVGLILGVMVWLGMKSVPIFFILMFFSMQLVTLPKQMLPESYQKYVYDWNPFTHYATSVRELLYLNHHIELNSTMWMFIGFMIFGAVSSLVSAIVRKHSTKRTEVPS

SEQ ID NO: 4455 - DNA, 621 bp, Staphylococcus aureus
ttgaaagaagataggcgaattagaaagacaaagtcctccattaaacaagcgttcactaaattactacaagaaaaagatttagaaaagattaccattcgcgacataacaacacgcgctgatatcaatagagggacattttacttacattacgaggataaatatatgttactcgcagatatggaagatgagtatatttcagaactaacgacatatactcaatttgatttgttacgcggttcttcaattgaagacattgcgaatacttttgtaaataatatactcaaaaatattttccaacatattcatgataatttagagttttatcatactattttacaattggaacgcacgagtcaattagaattgaaaatcaacgaacatattaaaaataatatgcaacgttacattagtatcaatcattctatcggaggcgttccagagatgtatttttacagttacgtttccggagcaacaatttcaattattaaatactgggtaatggacaaacagcccatttcagttgatgaattagctaaacatgtgcataatattatttttaatggtccattaagaataatggcaaaaaaccgtttgcataaatcaaaccttgattcactaact

SEQ ID NO: 4456 - protein, 207 aa, Staphylococcus aureus
  MISC_FEATURE (1)..(207): hypothetical protein
LKEDRRIRKTKSSIKQAFTKLLQEKDLEKITIRDITTRADINRGTFYLHYEDKYMLLADMEDEYISELTTYTQFDLLRGSSIEDIANTFVNNILKNIFQHIHDNLEFYHTILQLERTSQLELKINEHIKNNMQRYISINHSIGGVPEMYFYSYVSGATISIIKYWVMDKQPISVDELAKHVHNIIFNGPLRIMAKNRLHKSNLDSLT

SEQ ID NO: 4457 - DNA, 942 bp, Staphylococcus aureus
atgattacttcattcagacattctgaagatatagataaacatattataaaaacaccattagatcatacagcgtcatggattaatgtagtagaaccagaccgagaagaaattgaaaatcttatggaacaatataatatacctgaagactttatacgtgaccctttggactcagaagaaagttcccgtattgaatatgacgaagatactggttactcattaatcattattgatttacctatcgtcaattcaactaatcgtagcgttctatcttttgtaacgattccattaggcattattattggcaacggtattatcgtaacagtttgtgacgctgaaaatgaatttttagaaaatttacctaagcgtgatattaatttaaaatttcacagcagatttgcattagaaattttaactactattgccgaccattataatcgtaacttacgattacttaataaaagtagaattcgtattgagaaagaactaaaaaataacattactaacaaacaacttttcaaattaatggaagttgaaaaaagtttagtatactttttagctgccttaaaaggtaacgatacaattattaaaaagttattccgtttacctgcaattaaacgttttgaagaagatgaagaattactagaagatttaatcattgaaaataaccaagccatcgaaacaacagaattacatcaacgtatcttagaaagtatcacaacatcatacgcttccttattatctaatgatatgaatacgattatgaagacattaacacttttcacggtactattaacgttaccaacactcgtatttagtttcttcggtatgaatgtgccgttgccaattgatgaccatagttatatatcttggattattgtggtaggtatttcattaattcttgtcgtaattgttagtattttcttatggcgtaaacagaaatta

SEQ ID NO: 4458 - protein, 314 aa, Staphylococcus aureus
  MISC_FEATURE (1)..(314): hypothetical protein
MITSFRHSEDIDKHIIKTPLDHTASWINVVEPDREEIENLMEQYNIPEDFIRDPLDSEESSRIEYDEDTGYSLIIIDLPIVNSTNRSVLSFVTIPLGIIIGNGIIVTVCDAENEFLENLPKRDINLKFHSRFALEILTTIADHYNRNLRLLNKSRIRIEKELKNNITNKQLFKLMEVEKSLVYFLAALKGNDTIIKKLFRLPAIKRFEEDEELLEDLIIENNQAIETTELHQRILESITTSYASLLSNDMNTIMKTLTLFTVLLTLPTLVFSFFGMNVPLPIDDHSYISWIIVVGISLILVVIVSIFLWRKQKL

SEQ ID NO: 4459 - DNA, 861 bp, Staphylococcus aureus
atgatactagttcatccatcgctaatgagcgcatacgatttcccaaaagcagttgaagcaggtaaggctattccatattgggatgtttttggtttgcatattaatcaagtaggttatcaaggacaagtgttacctatgcttgtagcagcttatatcttagcctcaattgaaaaagggttacgcaaagttattccaacggtgttagataatttgttaacaccattgttatctatttttataacagcatttctaacattttcatttgtaggtccaatcactcgacaattaggttactggttatcagatggtttaacatggctttatgaatttggtggtgcaattggtggattaatattcggattattgtatgctccgattgttattacaggtatgcatcatagctttatagctgtagaaacgacattaattgcagatgccactaaaacgggtggatcatttatattcccgattgcgacaatgtctaatgttgcacaaggtggtgcagcaattgcagcgttctttattattaaacaaaataagaagttaaaaggtgtggcatctgccgcaggtatttcagcattacttggtattacagaaccggctatgtttggtgttaacttaaaactaagatatccatttattggcgctatcgttggatcaggtattggttcagcatatattgctttcttcaaggttaaagcaatcgcattaggaactgctggattgccaggatttatttcaatcaatccagtacatgcaggatggttacactactttgttggtatgacaatatcattcatcattgctataacagttactttaattttatctaaaagaaaagcaaataaagaagttgtagaa

SEQ ID NO: 4460 - protein, 287 aa, Staphylococcus aureus
  MISC_FEATURE (1)..(287): PTS system,
MILVHPSLMSAYDFPKAVEAGKAIPYWDVFGLHINQVGYQGQVLPMLVAAYILASIEKGLRKVIPTVLDNLLTPLLSIFITAFLTFSFVGPITRQLGYWLSDGLTWLYEFGGAIGGLIFGLLYAPIVITGMHHSFIAVETTLIADATKTGGSFIFPIATMSNVAQGGAAIAAFFIIKQNKKLKGVASAAGISALLGITEPAMFGVNLKLRYPFIGAIVGSGIGSAYIAFFKVKAIALGTAGLPGFISINPVHAGWLHYFVGMTISFIIAITVTLILSKRKANKEVVE

SEQ ID NO: 4461 - DNA, 108 bp, Staphylococcus aureus
atgttagttgattttatggataaaacaaactatacttgtgatattgtgacgttcgatgaattaacagcattcatcaatgacttacagtggtctgaagatcaaagtttc

SEQ ID NO: 4462 - protein, 36 aa, Staphylococcus aureus
  MISC_FEATURE (1)..(36): conserved hyothetical
MLVDFMDKTNYTCDIVTFDELTAFINDLQWSEDQSF

SEQ ID NO: 4463 - DNA, 342 bp, Staphylococcus aureus
atgtcagatgtttcattgaaattatcagcaaaagatatttatgaaaaagattttgaaaaaacgatggctcgtggctatagaagagaagaagtagatgcatttttagatgacattattgctgattatcaaaaaatggccgatatgaataatgaagttgtaaaattatcagaagagaatcataaacttaaaaaagaattagaagaattaagactacgtgtagcaacatcaagacctcaggacaataaaagtttttcttcgaataatacaacaacaaatacatcttcaaataatgtagatattttaaaacgtatttcaaacttagaaaaagctgtatttggtaaa

SEQ ID NO: 4464 - protein, 114 aa, Staphylococcus aureus
  MISC_FEATURE (1)..(114): conserved hypothetical
MSDVSLKLSAKDIYEKDFEKTMARGYRREEVDAFLDDIIADYQKMADMNNEVVKLSEENHKLKKELEELRLRVATSRPQDNKSFSSNNTTTNTSSNNVDILKRISNLEKAVFGK

SEQ ID NO: 4465 - DNA, 1008 bp, Staphylococcus aureus
atgaaaggtaaatttttaaaagttagttctttattcgttgcaactttgacaacagcgacacttgtgagttctccagcagcaaacgcgttatcttcaaaggctatggacaatcatccacaacaaacgcagtcaagcaaacagcaaacacctaagattcaaaaaggcggtaaccttaaaccattagaacaacgtgaacacgcaaatgttatattaccaaataacgatcgtcaccaaatcacagatacaacgaatggtcattatgcacccgtaacttatattcaagttgaagcacctactggtacatttattgcttccggtgtagttgtaggtaaagatactcttttaacaaataaacacgtcgtagatgctacgcacggtgatcctcatgctttaaaagcattcccttctgcaattaaccaagacaattatccaaatggtggtttcactgctgaacaaatcactaaatattcaggcgaaggtgatttagcaatagttaaattctcccctaatgagcaaaacaaacatattggtgaagtagttaaaccagcaacaatgagtaataatgctgaaacacaagttaaccaaaatattactgtaacaggatatcctggtgataaacctgtagcaacaatgtgggaaagtaaaggaaaaatcacttacctcaaaggcgaagctatgcaatatgatttaagtacaactggtggtaattcaggttcacctgtatttaatgaaaaaaatgaagtgatcggaattcattggggcggtgtaccaaatgaatttaatggtgcggtatttattaatgaaaatgtacgcaacttcttaaaacaaaatattgaagatatccattttgccaacgatgaccaacctaataacccagataatcctgataaccctaacaatcctgataaccctaacaacccagatgaaccaaataaccctgacaaccctaacaaccctgataatccagacaatggcgataacaataattcagacaatccagatgcagct

SEQ ID NO: 4466 - protein, 336 aa, Staphylococcus aureus
  MISC_FEATURE (1)..(336): serine protease
MKGKFLKVSSLFVATLTTATLVSSPAANALSSKAMDNHPQQTQSSKQQTPKIQKGGNLKPLEQREHANVILPNNDRHQITDTTNGHYAPVTYIQVEAPTGTFIASGVVVGKDTLLTNKHVVDATHGDPHALKAFPSAINQDNYPNGGFTAEQITKYSGEGDLAIVKFSPNEQNKHIGEVVKPATMSNNAETQVNQNITVTGYPGDKPVATMWESKGKITYLKGEAMQYDLSTTGGNSGSPVFNEKNEVIGIHWGGVPNEFNGAVFINENVRNFLKQNIEDIHFANDDQPNNPDNPDNPNNPDNPNNPDEPNNPDNPNNPDNPDNGDNNNSDNPDAA

SEQ ID NO: 4467 - DNA, 156 bp, Staphylococcus aureus
gtgatattttgggtaatcgctatattatatagaggaaagtccatgctcacacagtctgagatgattgtagtgttcgtgcttgatgaaacaataaatcaaggcattaatttgacggcaatgaaatatcctaagtctttcgatatggatagagtaatt

SEQ ID NO: 4468 - protein, 52 aa, Staphylococcus aureus
  MISC_FEATURE (1)..(52): hypothetical protein
VIFWVIAILYRGKSMLTQSEMIVVFVLDETINQGINLTAMKYPKSFDMDRVI

SEQ ID NO: 4469 - DNA, 1143 bp, Staphylococcus aureus
atgtttcaattacttgcagtttgtccgatgggattagaagctgttgttgctagggaaattcaagaattaggctatgaaacaaatgttgaaaatggtcgtatattttttgaaggagacgcaagtgcaattgtaaaggcaaatttatggttgcgcacagcagaccgaatcaaaattgttgttggacgttttaacgcaacaacgtttgacgaattattcgaacaaaccaaagcgctcccttgggaatctataattgataaagagggtaacttcccagttcaaggtagaagcgttaaatcaacactacatagtgtgccagattgtcaggcgataactaagaaagctattgttgaacgattacgtcgcgcatataacgaaaaaggttggttaaatgaatcaggtgccaaataccctgttgaagttgccattttaaaagataatgtattattgactatcgacacatcaggttctggtttgaacagacgtggttatagattagcacaaggtgaagcaccaattaaagaaacgttggcagcaagtttaatccgtcttgcaaactggaaaggtgatacacctttaattgatccattttgcggttcgggtacaatagctatagaagcttgtttaattgctcaaaatatcgcacctggttttaatcgcgagttcgtatcagagcaatggaacatcatgccagcaaatatttatgatgattaccgtgatgaagcggataagatggctgattatgataaagaaatcgaagtatatgcttctgatatcgatccagaaatggtagagattgctaagcgtaacgctgaagaagttgggttgtctgatattattaaatttagtgtaaaagatgtcaatacattaacaattgatacagaagaaccggtggcgttaattggaaatcctccatatggtgaacgtattggtgatcgtgaagaagttgaagaaatgtaccgttatattggtaaactaatgaaacaacatccatttttatctacatacattttaacaagtaataaagaatttgaatatttagtagatcgtaaagcaacaaagcgacgtaagttatttaatggatatatagaatgtacttattatcaatactggggtaaaaagacagaacgtaaaactattgaaaac

SEQ ID NO: 4470 - protein, 381 aa, Staphylococcus aureus
  MISC_FEATURE (1)..(381): conserved hypothetical
MFQLLAVCPMGLEAVVAREIQELGYETNVENGRIFFEGDASAIVKANLWLRTADRIKIVVGRFNATTFDELFEQTKALPWESIIDKEGNFPVQGRSVKSTLHSVPDCQAITKKAIVERLRRAYNEKGWLNESGAKYPVEVAILKDNVLLTIDTSGSGLNRRGYRLAQGEAPIKETLAASLIRLANWKGDTPLIDPFCGSGTIAIEACLIAQNIAPGFNREFVSEQWNIMPANIYDDYRDEADKMADYDKEIEVYASDIDPEMVEIAKRNAEEVGLSDIIKFSVKDVNTLTIDTEEPVALIGNPPYGERIGDREEVEEMYRYIGKLMKQHPFLSTYILTSNKEFEYLVDRKATKRRKLFNGYIECTYYQYWGKKTERKTIEN

SEQ ID NO: 4471 - DNA, 330 bp, Staphylococcus aureus
atgggtaaaaaaatgggtctaggtttatctattgcattggttgttattggtattgccgttgtatgtttaatgattttttctagtcaaaaaacgacttattttggttatatgaatagtaatacaaatgcagaaaaagttgtcagtgaaaaagatggattagtcaaacataatatcaaagtagaaccatctaatgatttcaagccgaaaaaaggagactttgtaaaattagtttctaaagatgatgggaagacattttataaacaagagattgttaaacatgatgacgtcccacacggtttaatgatgaaaattcacgacatgcatatgaat

SEQ ID NO: 4472 - protein, 110 aa, Staphylococcus aureus
  MISC_FEATURE (1)..(110): hypothetical protein
MGKKMGLGLSIALVVIGIAVVCLMIFSSQKTTYFGYMNSNTNAEKVVSEKDGLVKHNIKVEPSNDFKPKKGDFVKLVSKDDGKTFYKQEIVKHDDVPHGLMMKIHDMHMN

SEQ ID NO: 4473 - DNA, 156 bp, Staphylococcus aureus
atgagtgatatagatgctggtttttttacgcgatgtggtacttttactgcagtattttttgtacgctttatccaagagacaaaccccatgccaatggctactaataaagcgatacatacaaataaattaatgattttatttaaaatgccgaataaa

SEQ ID NO: 4474 - protein, 52 aa, Staphylococcus aureus
MSDIDAGFFTRCGTFTAVFFVRFIQETNPMPMATNKAIHTNKLMILFKMPNK

SEQ ID NO: 4475 - DNA, 1338 bp, Staphylococcus aureus
atgaaaaatacatttaatccattacaaagattacatttctatgcagcaatatttattgctccactgttaatcactttaaccatttcgggcattggttacttgttctttccagaagttgaaaataatatttataagaatgagttttttggtgacagtgatgtaaaaacgcatcaaacattaaatgatgcagtacatcaagttgaacaacaatatgaaggattctttgtaagtaaagttagcatacttgatgaaccatataacaaacgaattacactgagtgatatggcaggaaatcaacgttacgtctttctagatcataacaatcaatttgttgcagatcaaaatgcgaaacatacgtattctaatgtgatgcgaagtatacatagttctttgtttactgaaaatactattattaattatttagtagagttaaccgcatgttggatgatattcatgattttatctggtacttatttactcattaagaagcatttaatttctaacaaaagtaaggcacttcgttggcaaaagtggcacgcaatgattggagttatcattgcaattccagtatttgtattagtcttaactggattgccatggtctggttttatgggcagtaaaattgccggtatgatggacacaaacggtgaccttggtcaaggtgaattagcgattaatccacctaaatcagatttgaacgaattaccttgggctacacgtaaaaataaacagccagcttcatccgaaaaaggttcaagtggtcatcatggtaatgcagcaatgcctcaaaccaaattagattatcaaatatctattgataaggtcgttgaacaggcgcaaaaagctggtattaaaaagccgttttcaatcgtatatccaagtgataaaaatggtacctttattgtatctaatactagtaattcaggtgttactgggctagatgtatcaccatacaaggaacaaacactttatttcgatcaatatagcggtaaaaagctaggtacgattaaatatgatgactacggtattattgctaaatggtttacatggggcattccgcttcacgaaggtcatttattcggcattttaaataaaatcattaatttatttgtatgtatcgctttattagtagccattggcatggggtttgtctcttggataaagcgtacaaaaaatactgcagtaaaagtaccacatcgcgtaaaaaaaccagcatctatatcactcataatatgtttaattgtattaggattattaatgccattatttggattatcacttatccttgtatttataattgaattaatattatatattaaagatcgtcgtgctaaacaa

SEQ ID NO: 4476 - protein, 446 aa, Staphylococcus aureus
  MISC_FEATURE (1)..(446): conserved hypothetical
MKNTFNPLQRLHFYAAIFIAPLLITLTISGIGYLFFPEVENNIYKNEFFGDSDVKTHQTLNDAVHQVEQQYEGFFVSKVSILDEPYNKRITLSDMAGNQRYVFLDHNNQFVADQNAKHTYSNVMRSIHSSLFTENTIINYLVELTACWMIFMILSGTYLLIKKHLISNKSKALRWQKWHAMIGVIIAIPVFVLVLTGLPWSGFMGSKIAGMMDTNGDLGQGELAINPPKSDLNELPWATRKNKQPASSEKGSSGHHGNAAMPQTKLDYQISIDKVVEQAQKAGIKKPFSIVYPSDKNGTFIVSNTSNSGVTGLDVSPYKEQTLYFDQYSGKKLGTIKYDDYGIIAKWFTWGIPLHEGHLFGILNKIINLFVCIALLVAIGMGFVSWIKRTKNTAVKVPHRVKKPASISLIICLIVLGLLMPLFGLSLILVFIIELILYIKDRRAKQ

SEQ ID NO: 4477 - DNA, 3438 bp, Staphylococcus aureus
atgattaataaagaacaattagatcttttatataaattaaaaaaagaagttgaaaagtcgcgaaatgaagcacttttacatacaattaaccaagtaattaagaaagtatatttgcagcaatatacatgttcgttcgttggacatttttctgcaggtaaatcgacactgataaatttattaattgaacaagatatcttaccaagttcacctgtaccaacgacaagtaatactgctattgtgtcagtttcagacaatcacgatattattgctaatttgccgaatcaaacgtatgccaaattatctaattatgatgaagtaagggaaatgaatcgccaaaatgtcgacgttgaatctgtagaaattaattttcaatcagctaaatttgaaaatgggtttacgttgcaagatacaccaggtgttgattcaaatgttgcatcacatcagtcaataacagaacaatatatgtatacaagtaatatgatattttatacggttgactataaccacgttcaatctgaacttaactttaagtttatgaagcatataaatgatgttggaatacctgttgtgtttatcattaatcaaattgacaagcatcaagacgatgaattgtcattctctacgtttaaatctcgagttgaaaaatcaattgcagattggggtattaaattagaacgcaccttttatgtatctaaatttgatcaccctgaaaatgaacttgaagtattatcaagttatctaatttcattagatcaacatagagagacaatagaggattatacatcaagaacggttgaatacattaccgaagctcagctagattacattcagtctgaaattcaggaagtactagaagatttaggtatcgaagaagcggagtttgaacaagcatttttaaatagtcaacaacatcaagcaattagtgaagaggcacaacttttaaataatccagatgaattaatggcatttttaaagaataagcgtaaaaatattttagaaaatgcatacattatgccgcataatatgagagaaatgttacgaagttatttggaaagtatgtctcaagactttaatgttggcggattttttaataaaaagaagaaaaaactacaaattcaacaacagcgattattaacagcgacagatgcgttacaagaacatgttaatcaacaaattcgtcaaccaatgcgagaagatatgtcatttgttacgcgttttatcaataaaaaagaagcttcagataaagtattaaatcagcattatgacgttaagccagaaatgattgaaggtttatatcaaccacaaacatcaatcagcaatacttatgtacttacattttcagacgaagtggttaaagccattaagaaatatgttgaacaacaatcaacaccaatttttaaagaaataatagaaaatgtgcaggcagatgaattaccaacagaagaaagtgatgatttaaaagaatatcaacgttatacagaattaaatgagctgcgtcagtcattgacgactaagaattatcgtcactactatattcatttagatgaatctctagataaattaataggtcgacaagagacaacatatcaagtggctactgataatgctcaggataatcgtgataatcagcagctaaatcaaaatacagctacaacaaatatgtctatagatattcaaaaagcgcttgatataatttcggatgtgcctttgttcaagcgtacaaagcaagatatccacgaaacattaacacgtatagataataaattaataaaaataggtgtatttggaacatttagtgctggtaaaagtagtttgataaatgcattattaggcgagcatattttagtcagttctccaaatcctactacagcagctactacagaaatatcttatggagacgagagttatataacgctaaaatcacaatcgcaattattagatgaaattaatgcagtagttgaataccaagatatgtcttattcgactatagaagactttattaattcagatttagaaaagttaaaatcacatttaaataaaaatcaactcgcttttattcaggcagttgaaaaacattataaattgtatgtcaatatgttggaaaatggagaaaaacatgccattaatcaacaggaattgaaaaagtggagtgcagaagatgaatatgcaacatttgttaagacagtacacattgcattaatgcatgattggttaaaaggtaaaataattgttgattcattagggctacactcaaataaccaaaggcatacaaatgaaaccgaacaaattttaacttcttcagacttaatattgtatgtaagttattttaatcattcatttactgataatgacaaagcgtttatagaacacatgaaagatatgaaccagttgaatgaaaaccaagcatttaaaatggtaattaatgctgctgatttagcagaaagtcaagatgatcttgaagcagttgaaacatatgtatcagatgcattaagacaagtacacttacaatcagacatttttgctgtatcaagtcgaaatgcattgcaagctgaagataagggcattgatcaattaaaacaaagcatacaacaatttgttgatgttgaatctaaatcaattttagaacaacaaatgattcatcagcttcaacaaatggatcgttcttatgtagagatgattacagaatttgaaacaaataaagctgatatttcacgtcgccaacaaaggttaacagattataaagataaacagcgtttacaacatcaattaattgatgcgacgttacaacatacagacaacgaagttgaagaacaagtttatcatttaaatgcccgtttaaaactacaactacttgacgatgttaaatcagtgtttaattctcaaatgacgcaaaatagtgattttaatgaagaaaagaaagtgtctacgagagtatacttagatcaaattcatcaacgattgtttttagagcaatctttaattacagaacgtataaaaaaatactttaataagcaactcactgagcaaattgcaccaatcgttcaacaattagcagatttacatgtcattattaatcctcagtttaactttgaatcagctaatatagagcaaccattattgcacatcgatttcaacgatatgctaaatgcattgcctaaacaattaacaaaacgtaaaattttgaatccaaatgggcaaagagatatacatgaatcaatttgtcaaagtacgttaggattattacaaccacaaatgggattattgaggcaacagcttgaattatatgtaaagcaaatggctgtagaagctgaatcgcaatttgaaagttttgaagctaatattcaaacgcaaataaacgatttattagcatttgatttagatacaacacttatcaatcaattgaaagataaacatcaacaactgaaaactattttatat

SEQ ID NO: 4478 - protein, 1146 aa, Staphylococcus aureus
  MISC_FEATURE (1)..(1146): conserved hypothetical
MINKEQLDLLYKLKKEVEKSRNEALLHTINQVIKKVYLQQYTCSFVGHFSAGKSTLINLLIEQDILPSSPVPTTSNTAIVSVSDNHDIIANLPNQTYAKLSNYDEVREMNRQNVDVESVEINFQSAKFENGFTLQDTPGVDSNVASHQSITEQYMYTSNMIFYTVDYNHVQSELNFKFMKHINDVGIPVVFIINQIDKHQDDELSFSTFKSRVEKSIADWGIKLERTFYVSKFDHPENELEVLSSYLISLDQHRETIEDYTSRTVEYITEAQLDYIQSEIQEVLEDLGIEEAEFEQAFLNSQQHQAISEEAQLLNNPDELMAFLKNKRKNILENAYIMPHNMREMLRSYLESMSQDFNVGGFFNKKKKKLQIQQQRLLTATDALQEHVNQQIRQPMREDMSFVTRFINKKEASDKVLNQHYDVKPEMIEGLYQPQTSISNTYVLTFSDEVVKAIKKYVEQQSTPIFKEIIENVQADELPTEESDDLKEYQRYTELNELRQSLTTKNYRHYYIHLDESLDKLIGRQETTYQVATDNAQDNRDNQQLNQNTATTNMSIDIQKALDIISDVPLFKRTKQDIHETLTRIDNKLIKIGVFGTFSAGKSSLINALLGEHILVSSPNPTTAATTEISYGDESYITLKSQSQLLDEINAVVEYQDMSYSTIEDFINSDLEKLKSHLNKNQLAFIQAVEKHYKLYVNMLENGEKHAINQQELKKWSAEDEYATFVKTVHIALMHDWLKGKIIVDSLGLHSNNQRHTNETEQILTSSDLILYVSYFNHSFTDNDKAFIEHMKDMNQLNENQAFKMVINAADLAESQDDLEAVETYVSDALRQVHLQSDIFAVSSRNALQAEDKGIDQLKQSIQQFVDVESKSILEQQMIHQLQQMDRSYVEMITEFETNKADISRRQQRLTDYKDKQRLQHQLIDATLQHTDNEVEEQVYHLNARLKLQLLDDVKSVFNSQMTQNSDFNEEKKVSTRVYLDQIHQRLFLEQSLITERIKKYFNKQLTEQIAPIVQQLADLHVIINPQFNFESANIEQPLLHIDFNDMLNALPKQLTKRKILNPNGQRDIHESICQSTLGLLQPQMGLLRQQLELYVKQMAVEAESQFESFEANIQTQINDLLAFDLDTTLINQLKDKHQQLKTILY

SEQ ID NO: 4479 - DNA, 876 bp, Staphylococcus aureus
atgcctaataaaatattacttgtagatggtatggcgctattatttagacatttctatgctacaagtcttcataaacaatttatgtacaattcacaaggtgaacctacaaatggaatacaaggatttgtgcgtcatatcttttcggcaatacatgaaatacgccctacacatgtagctgtatgttgggatatgggacaatcaacttttagaaatgatatgtttgatggttataagcaaaatcgttctgcaccaccagaagaattgataccacaatttgattatgttaaagaaatttcagagcaatttggctttgtaaatattggcgttaaaaactatgaagcggatgatgttataggtacattagcacaacaatattcaactgataacgatgtctatattattacgggcgacaaagatttactgcaatgtattaatgacaatgttgaagtttggctaattaaaaaaggttttaacatttataatagatatacattacatcgttttaacgaagaatatgcccttgaaccacaacaactaatcgatattaaagcgtttatgggtgatacagcagatggatatgcgggtgttaaaggtattggcgagaaaacggctattaagttaattcagcaatatcaaagcgttgaaaatgtggttgaaaacattgatgcattatcagctgggcaacgtaataagattaatgacaatttagatgaactatatttatcgaagcgactggctgaaattcacacacaagtaccaattgatagtgaagcgctttttgagaaaatgtcatttgcaacaacgcttaatcatattttatcaatttgtaacgaacatgaattacatgtttcaggaaaatatatttcatcccatttt

SEQ ID NO: 4480 - protein, 292 aa, Staphylococcus aureus
  MISC_FEATURE (1)..(292): hypothetical protein
MPNKILLVDGMALLFRHFYATSLHKQFMYNSQGEPTNGIQGFVRHIFSAIHEIRPTHVAVCWDMGQSTFRNDMFDGYKQNRSAPPEELIPQFDYVKEISEQFGFVNIGVKNYEADDVIGTLAQQYSTDNDVYIITGDKDLLQCINDNVEVWLIKKGFNIYNRYTLHRFNEEYALEPQQLIDIKAFMGDTADGYAGVKGIGEKTAIKLIQQYQSVENVVENIDALSAGQRNKINDNLDELYLSKRLAEIHTQVPIDSEALFEKMSFATTLNHILSICNEHELHVSGKYISSHF

SEQ ID NO: 4481 - DNA, 1152 bp, Staphylococcus aureus
gtgaaattattcacaaatgaaagaggagtgttgcaaatgttagttgcagtagtcaaagaattaaaacaaggtgaaggacgtgtagcttgcacacccgaaaatgtgcgtaagttaacggatgcaggacataaagtaattgttgaaaaaaatgctggcattggttcaggattttctaacgatatgtatgaaaaagaaggcgctaagatcgtaactcacgaacaagcatgggaagctgatcttgttatcaaagtaaaagaacctcatgaaagcgaatatcaatatttcaaaaagaatcaaattatctggggatttttacatctagcatcttcaaaagaaatagtagaaaaaatgcaagaagttggtgtaactgcgattagtggtgaaaccattataaaaaatggaaaagcagaattattagcgccaatgagtgctatagcaggtcaacgctcagcaattatgggagcttactactctgaagcacaacatggtggtcaaggtactttagtgactggtgtacatgaaaatgtggatatacctggtagtacatatgtgattttcggtggtggagtagcagcaacaaatgcagcaaatgttgccttgggactaaatgctaaagtaatcattatcgagttaaacgatgaccgcattaaatatcttgaagatatgtatgcagaaaaagatgtcacagtagtcaaatcaacaccagaaaatttagcagaacaaattaagaaagcagatgtatttatttctacaattttaatttcaggtgcgaaaccgccaaaattggttactcgtgagatggttaaatcaatgaaaaaaggttcagtattaatcgatatagctattgaccaaggtggaactattgaaacaattagaccaactacaatttctgatccagtgtatgaagaagaaggtgtgattcattatggtgtaccaaatcaaccaggagcagtcccaagaacttcaacaatggcattagcacaaggaaatattgattatatattagaaatttgtgacaaaggcttagaacaagcaattaaagataatgaagccttaagtactggtgtaaacatttaccaaggacaagtgacaaatcaaggattagcttcatcacatgacctagattataaagaaatattaaatgttatcgaa

SEQ ID NO: 4482 - protein, 384 aa, Staphylococcus aureus
  MISC_FEATURE (1)..(384): alanine dehydrogenase
VKLFTNERGVLQMLVAVVKELKQGEGRVACTPENVRKLTDAGHKVIVEKNAGIGSGFSNDMYEKEGAKIVTHEQAWEADLVIKVKEPHESEYQYFKKNQIIWGFLHLASSKEIVEKMQEVGVTAISGETIIKNGKAELLAPMSAIAGQRSAIMGAYYSEAQHGGQGTLVTGVHENVDIPGSTYVIFGGGVAATNAANVALGLNAKVIIIELNDDRIKYLEDMYAEKDVTVVKSTPENLAEQIKKADVFISTILISGAKPPKLVTREMVKSMKKGSVLIDIAIDQGGTIETIRPTTISDPVYEEEGVIHYGVPNQPGAVPRTSTMALAQGNIDYILEICDKGLEQAIKDNEALSTGVNIYQGQVTNQGLASSHDLDYKEILNVIE

SEQ ID NO: 4483 - DNA, 1038 bp, Staphylococcus aureus
atgacaaccaacacagttacattacaaacagcacatattgtaagtttaggagatatcgaagaagctaaagcaagcattaaaccatttattcgtcgaacacctctaattaaatcaatgtatttaagccaaagtataactaaagggaatgtatttctaaaattagaaaatatgcaattcacaggatcttttaaatttagaggcgctagcaataaaattaatcacttaacagatgaacaaaaagaaaaaggcattatcgcagcatctgctgggaaccatgcacaaggtgttgctttaacagctaaattattaggcattgatgcaacgattgtaatgcctgaaacagcaccacaagcgaaacaacaagcaacaaaaggctatggggcaaaggttattttaaaaggtaaaaactttaacgaaactagactttatatggaagaattagcgaaagaaaatggcatgacaatcgttcatccatatgacgataagtttgtaatggcaggccaaggaacaattggtttagaaattttagatgatatttggaatgtgaatacagtcatcgtaccagttggcggtggaggattaattgcaggtattgccaccgcattaaaatcatttaacccttcaattcatattatcggtgttcaatctgagaatgttcatggtatggctgagtctttctataagagagatttaactgaacatcgagtggatagcacaatagcagatggttgtgatgtaaaagttcctggtgaacaaacatatgaagtagttaaacatttagtagatgaatttattcttgttactgaagaagaaattgaacatgctatgaaagatttaatgcagcgtgccaaaattattactgaaggtgcaggcgcattaccaacagctgcaattttaagtggaaaaataaacaataaatggcttgaagataaaaatgttgttgcattagtttcaggcgggaatgttgacttaactagagtttcaggtgtcattgaacatggactgaatattgcagatacaagcaagggtgtggtaggt

SEQ ID NO: 4484 - protein, 346 aa, Staphylococcus aureus
  MISC_FEATURE (1)..(346): threonine deaminase IlvA
MTTNTVTLQTAHIVSLGDIEEAKASIKPFIRRTPLIKSMYLSQSITKGNVFLKLENMQFTGSFKFRGASNKINHLTDEQKEKGIIAASAGNHAQGVALTAKLLGIDATIVMPETAPQAKQQATKGYGAKVILKGKNFNETRLYMEELAKENGMTIVHPYDDKFVMAGQGTIGLEILDDIWNVNTVIVPVGGGGLIAGIATALKSFNPSIHIIGVQSENVHGMAESFYKRDLTEHRVDSTIADGCDVKVPGEQTYEVVKHLVDEFILVTEEEIEHAMKDLMQRAKIITEGAGALPTAAILSGKINNKWLEDKNVVALVSGGNVDLTRVSGVIEHGLNIADTSKGVVG

SEQ ID NO: 4485 - DNA, 1320 bp, Staphylococcus aureus
atgtcaaatggtaaagaattacaaaaaaatataggtttcttctcagcgtttgctattgttatggggacagttattggttcaggagtattctttaaaatatcaaacgtaacagaagtaacaggaacagcaggaatggccttgtttgtatggttcctaggcggcatcattaccatttgtgcggggttaacagcagcagaacttgctgctgcaatccctgaaacaggtggcttaacgaagtatatagaatatacatacggtgatttctggggcttcctatcaggttgggcgcaatcatttatttattttccagctaacgtagcagcattgtctatcgtatttgcgacacagctaattaatttattccatttatctataggttcgttaataccaatagcaatcgcatctgcgttatctattgtgttgataaatttcctaggttcaaaagcaggcggaattttacaatcagttactttagtaattaaactgattccaatcatcgttattgtaatttttggtatttttcaatctggagatatcactttttcattaattccaactacaggtaattcaggaaatggcttctttacagcaattggtagtggtttattagcaactatgtttgcatatgatggttggattcatgtaggaaatgttgcgggggaacttaaaaatcctaaacgcgatttacctttagcgatttcagttggtatcggttgtattatggctgtgtatttattaattaacgctacattcttattaacgttgccaatagaactacttgctggtaatttaaatgcagcttcagatacatcaaaaatattatttggtgaaaatggcggtaagattattacaatcggtatattaatttctgtttatggtacgatcaatggctatactatgactggtatgcgcgtaccatatgcaatggctgaaagaaaattattgccatttagccatttattcgcaaaattaacaaaatctggcgcaccatggtttggcgcaattatacaacttataatcgctatcatcatgatgtcaatgggagcatttgatacaattacaaatatgttaatctttgttatttggttgttctattgtatgtcatttgttgcggtaataattttaagaaaacgtgaaccaaatatggaacgaccatataaagtaccgttatatccgatcatacctttaattgctattttggcaggatcatttgtattaattaatacactgtttacacaatttatattagcaatcattggaattctaataacagcacttggtataccagtttattactataaaaagaaacaaaaagcagca

SEQ ID NO: 4486 - protein, 440 aa, Staphylococcus aureus
  MISC_FEATURE (1)..(440): hypothetical protein
MSNGKELQKNIGFFSAFAIVMGTVIGSGVFFKISNVTEVTGTAGMALFVWFLGGIITICAGLTAAELAAAIPETGGLTKYIEYTYGDFWGFLSGWAQSFIYFPANVAALSIVFATQLINLFHLSIGSLIPIAIASALSIVLINFLGSKAGGILQSVTLVIKLIPIIVIVIFGIFQSGDITFSLIPTTGNSGNGFFTAIGSGLLATMFAYDGWIHVGNVAGELKNPKRDLPLAISVGIGCIMAVYLLINATFLLTLPIELLAGNLNAASDTSKILFGENGGKIITIGILISVYGTINGYTMTGMRVPYAMAERKLLPFSHLFAKLTKSGAPWFGAIIQLIIAIIMMSMGAFDTITNMLIFVIWLFYCMSFVAVIILRKREPNMERPYKVPLYPIIPLIAILAGSFVLINTLFTQFILAIIGILITALGIPVYYYKKKQKAA

SEQ ID NO: 4487 - DNA, 621 bp, Staphylococcus aureus
atgaacaaagtaatattagtagatgaccattatattgtgcgacaaggattgcgatttttattatccacgattgaaaacatagaagttttacaagactttgcagatggagaaacatttttagaatatttaaaagagcatgagcaccctgatattgtgctattagatttagtgatgcctggcatgaatggtattgaaattacggaatatattaaggcacattatccggatattaaagttttggtattaacaagttatgttgatgatgaacatgtaatttcagcaatcaataaaggtgctgatggttatgaaatgaaagacgttgagcctcagcaattaattgaaactattagacgagttatgaacggtgaaaaaatgatacatcctaaggcacaagatgtattcgaaacagttagccaaaaaccacactacacgaataagttgtcaaagagagaaattgaagtgttacgtgaaatggttaaaggtaaaacaaataaagagattgcagaaactttatttgtatctgaaaaaacaattaaaacacatgtcagtcatatatttagtaaattacaagttagcgatcgtacacaagcagcaatttatgcaatggaaaataagttgatt

SEQ ID NO: 4488 - protein, 207 aa, Staphylococcus aureus
  MISC_FEATURE (1)..(207): two-component response
MNKVILVDDHYIVRQGLRFLLSTIENIEVLQDFADGETFLEYLKEHEHPDIVLLDLVMPGMNGIEITEYIKAHYPDIKVLVLTSYVDDEHVISAINKGADGYEMKDVEPQQLIETIRRVMNGEKMIHPKAQDVFETVSQKPHYTNKLSKREIEVLREMVKGKTNKEIAETLFVSEKTIKTHVSHIFSKLQVSDRTQAAIYAMENKLI

SEQ ID NO: 4489 - DNA, 1455 bp, Staphylococcus aureus
atggaacagacaaatttctgttatggaatttgtctgtttttcaaaagtatagggaggcaaatagagatggaaaagccgtcaagagaggcatttgaaggcaataataagttgttaataggaattgttctaagtgtaataacgttttggctatttgcacaatcattggttaatgttgtaccaatacttgaagatagtttcaatacagatattggaacggttaatatcgccgttagtataactgctttattttcaggaatgtttgtagtaggagcaggtggtcttgctgataaatatggcagaattaaactcacgaacattggtattatcttaaatatattaggttcattattaatcattatttcaaatattcctttattacttattataggaagattaattcaaggactttcagcagcatgtattatgcctgcaactttgtctattattaagtcatattacattgggaaagatagacaacgcgctttaagttattggtcaattggctcatggggcggctctggtgtttgttcattttttggaggtgcagttgcaacgcttttaggttggcgttggattttcatcctatcaattataatttcattaattgcactgtttcttattaaaggcacacctgaaactaaatctaaatcgatttctctaaataaatttgacattaaaggtctggttcttttagtcattatgctcctcagtttaaatattttaattactaaaggatcagaattaggtgtaacctcacttctttttattactttattagctattgcaattggatcttttagtttatttatagttcttgaaaagcgtgctacaaatcctttaatcgattttaaattatttaaaaataaagcttacacaggtgcaacagcttcaaactttttgttaaatggtgttgcaggaacattaatagtagccaacacatttgttcaaagaggtttaggatattcttcattgcaagcaggaagtttatcaatcacttatttagtaatggtactaattatgattcgtgttggtgaaaagttacttcaaacactcggatgcaagaaaccaatgttaattggaacaggagttcttattgtcggagaatgtctcatttcattaactttcttgccagaaatattctatgtcatttgttgtattataggttatttattctttggtttaggactagggatatatgctacaccatcaacagatacagcaattgcaaatgcaccgttagaaaaagtaggcgttgctgcaggtatctataaaatggcttctgcattaggtggagcatttggcgtcgcattgagtggtgcagtatatgcaatcgtatcaaatatgacaaacatttatacaggtgcaatgattgcattatggttaaatgcaggtatgggaatattatcattcgttatcattttgttacttgtgcctaaacaaaacgacactcaatta

SEQ ID NO: 4490 - protein, 485 aa, Staphylococcus aureus
  MISC_FEATURE (1)..(485): Blt-like protein
MEQTNFCYGICLFFKSIGRQIEMEKPSREAFEGNNKLLIGIVLSVITFWLFAQSLVNVVPILEDSFNTDIGTVNIAVSITALFSGMFVVGAGGLADKYGRIKLTNIGIILNILGSLLIIISNIPLLLIIGRLIQGLSAACIMPATLSIIKSYYIGKDRQRALSYWSIGSWGGSGVCSFFGGAVATLLGWRWIFILSIIISLIALFLIKGTPETKSKSISLNKFDIKGLVLLVIMLLSLNILITKGSELGVTSLLFITLLAIAIGSFSLFIVLEKRATNPLIDFKLFKNKAYTGATASNFLLNGVAGTLIVANTFVQRGLGYSSLQAGSLSITYLVMVLIMIRVGEKLLQTLGCKKPMLIGTGVLIVGECLISLTFLPEIFYVICCIIGYLFFGLGLGIYATPSTDTAIANAPLEKVGVAAGIYKMASALGGAFGVALSGAVYAIVSNMTNIYTGAMIALWLNAGMGILSFVIILLLVPKQNDTQL

SEQ ID NO: 4491 - DNA, 96 bp, Staphylococcus aureus
ttggcatttattccaacaggattattgattgttggtggaatgtcatctggcaaaatagtaacagcattactcatattagatgcaactactttatta

SEQ ID NO: 4492 - protein, 32 aa, Staphylococcus aureus
LAFIPTGLLIVGGMSSGKIVTALLILDATTLL

SEQ ID NO: 4493 - DNA, 180 bp, Staphylococcus aureus
ttggcaattctcacaggattagcagccgttgatgaagtaccaactcgatatttatcacgcaaaggtttcactgttacattgaacgaagttgtagctgtattgccgcttgtatcagttgctaataaattgattgtcttattagttgctgatgtcacatttggtgccgttgcagaaacatgt

SEQ ID NO: 4494 - protein, 60 aa, Staphylococcus aureus
LAILTGLAAVDEVPTRYLSRKGFTVTLNEVVAVLPLVSVANKLIVLLVADVTFGAVAETC

SEQ ID NO: 4495 - DNA, 28605 bp, Staphylococcus aureus
gtgaattatcgtgataaaattcaaaagtttagtattcgtaaatatacagttggtacattttcaactgtcattgcgacattggtatttttaggattcaatacatcacaagcacatgctgctgaaacaaatcaaccagcaagcgtggttaaacagaaacaacaaagtaataatgaacagactgagaatcgagaatctcaagtacaaaattctcaaaattcacaaaatggtcaatcattatctgctactcatgaaaatgagcaaccaaatattagtcaagctaatttagtagatcaaaaagtagcgcaatcatctactactaatgatgaacaaccagcatctcaaaatgtaaatacaaagaaagattcggcaacggctgcgacaacacaaccagataaagaacaaagtaagcataaacaaaacgaaagtcaatctgctaataaaaatggaaacgacaatagagcggctcatgtagaaaatcatgaagcaaatgtagtaacagcttcagattcatctgataatggtaacgtacaacatgaccgaaatgaattacaagcgttttttgatgcaaattatcatgattatcgctttattgaccgtgaaaatgcagattctggcacatttaactatgtaaaaggcatttttgataagattaatacgttattaggcagtaatgatccaataaacaataaagacttgcaacttgcatacaaagaattggaacaagctgttgctttaattcgtacaatgcctcaacgtcaacagactagccgacgttcaaatagaattcaaacgcgttcggttgagtcaagagctgcagagcctagatcagtatcagactatcaaaatgcaaattcatcatattatgttgaaaatgctaatgatggttcgggctatcctgttggtacatatatcaatgcttctagtaaaggggcgccatataatttaccaactacaccatggaatacattgaaggcctctgactcaaaggaaattgctcttatgacagcgaaacaaactggagacgggtaccaatgggttattaagtttaataaaggacatgctccacatcaaaatatgatcttttggtttgcattaccagcagaccaagtgccagtaggaagaactgactttgtaacagttaattcagatggaacaaatgtacaatggagtcatggagcaggagcaggtgcaaataaaccacttcaacaaatgtgggaatatggagtaaatgatcctcatcgttcacatgactttaaaataagaaatagaagtggccaagtaatatatgactggccaactgtccatatttattctttagaagatttatctagagcgagtgattattttagtgaagctggagcgacacctgctactaaagcttttggtagacaaaattttgaatatattaatggtcaaaaacctgctgaatcaccgggtgttcctaaagtttatactttcatcggtcaaggtgatgcaagttatacaatttcatttaaaacacaaggtccaactgttaataaattgtactatgcagcaggtgggcgtgctttagagtacaatcaattatttatgtacagtcaactatacgtcgaatcaacgcaagaccatcaacaacgtcttaatggtttaagacaagtggttaatcgtacatatcgcataggtacaactaaacgtgtagaagtgagtcaaggaaatgtacaaacgaaaaaggtattagaaagtacaaacctaaatatagatgattttgttgatgatcctttaagttatgttaagacgccgagtaataaagtgttaggattttattcgaataatgcaaatactaatgcttttagaccgggtggagcccaacaattaaatgaatatcaattaagtcaattatttactgatcaaaaattacaagaagcagcaagaactagaaacccaataagattaatgattggtttcgactatcctgatgcttatggtaatagtgaaactttagttcctgttaacttaacggtattacctgaaatccaacataatattaaattctttaaaaatgacgatactcaaaatattgctgaaaaaccattttcaaaacaagctgggcatccagttttctatgtatatgcaggtaaccaagggaatgcttccgtgaatttaggtggtagcgtaacatctattcaaccattacgtattaatttaacaagtaatgagaattttacagataaagattggcaaattacaggtattccgcgtacattacacattgaaaactcgacaaatagacctaataatgccagagaacgcaatattgaacttgttggtaacttattaccaggggattactttggaacgatacgttttggacgtaaagaacaattattcgaaattcgtgttaaaccacatacaccaacaattacaacgacagctgagcaattaagaggtacagcattacaaaaagtgcctgttaatatttcgggaataccgttggatccatcggcattggtttatttagttgcaccaacaaatcaaactacgaatggtggtagtgaggcagatcaaataccatctggttatacgatacttgcgactggtacacctgatggggtgcataatacaattactatacgaccgcaagattatgttgtattcataccacctgtaggtaaacaaattagagcagtagtttattataataaagtagttgcatctaatatgagtaatgctgttactattttgccagatgacattccaccaacaatcaataatcctgttggaataaatgccaaatactatcgaggcgacgaagtcaactttacaatgggtgtctctgatagacattctggtataaaaaatacaactattacgacattgccgaatggttggacatcaaatttaacaaaagcggataagaataatggctcattatctattacaggtagagtgagtatgaatcaggcatttaacagtgatattacatttaaagtgtcagcgacagacaatgtcaataatacgacaaatgatagtcaatctaaacatgtttcaattcatgtaggtaaaattagtgaagatgctcatccgattgtattaggaaatactgagaaagttgtagtagtcaatccgactgctgtatctaatgatgaaaagcaaagcataattactgcctttatgaataaaaaccaaaatataagaggatatttagcatcaactgatccagtaactgtcgataataatggtaatgtcacattacattaccgtgatggctcatcgacaacgcttgatgctacaaatgtgatgacatacgaaccagttgtgaaacctgaataccaaactgtcaatgctgctaaaacagcaacggtaacgattgctaaaggacaatcatttagtattggtgatattaaacaatattttactttaagtaatggacaacctattccaagtggcacatttacaaatattacatctgatagaactattccaactgcacaagaagttagtcaaatgaacgcaggcacgcagttataccatataactgctacaaatgcgtatcataaagatagtgaagacttctatattagtttgaaaatcatcgatgtgaaacaaccagaaggcgatcaacgtgtatatcgtacatcaacatatgatttaactactgatgaaatctcaaaagtaaaacaagcatttattaatgcaaatagagatgtaattacgcttgccgaaggtgatatttcagttacaaatacacctaatggtgctaatgtaagtactattacagtaaatattaataaaggtcgattaacgaaatcattcgcgtcaaacctagctaatatgaatttcttgcgttgggttaatttcccacaagattatacagtgacatggacgaatgcaaaaattgcaaacagaccaacagatggtggtttatcatggtctgatgaccataaatctttaatttatcgttatgatgctacattaggtactcaaattacgacgaatgatattttaacaatgttaaaagcaacaactacagtgcctggattgcgaaataacattactggtaatgaaaaatcacaagcagaagctggcggaagacctaactttagaacgactggttattcacaatcaaatgcgacaactgatggtcaacgtcaatttacgttgaatggtcaagtgattcaagtgttagacatcatcaacccttcaaacggttatggtgggcaacctgttacaaattcaaatactcgtgcaaaccatagtaactcaactgttgttaacgtaaacgaaccggcagctaatggtgctggcgcatttacaattgaccacgttgtaaaaagtaattctacacataatgcaagtgatgcagtttataaagcacagttatacttaacgccatatggtccaaaacaatatgttgaacatttaaatcaaaatacaggaaatactactgacgctattaacatttattttgtaccaagtgacttagtgaatccaacaatttcagtaggtaattacactaatcatcaagtgttctcaggtgaaacatttacaaatactattacagcgaatgataactttggtgtgcaatctgtaactgtaccaaatacatcacaaattacaggtactgttgataataaccatcaacatgtttctgcaacggcaccaaatgtgacatcagcaactaataagacaatcaatttattagcaactgatacaagcggcaatacagctacaacttcgttcaatgtaacagtgaaacctttgcgtgataaatatcgagttggtacttcatcaacggctgctaatcctgtgagaattgccaatatttcgaataatgcgacagtatcacaagctgatcaaacgacaattattaattcgttaacgtttactgaaacagtaccaaatagaagttatgcaagagcaagtgcgaatgaaatcactagtaaaacagttagtaatgtcagtcgtactggaaataatgccaatgtcacagtaactgttacttatcaagatggaacaacatcaacagtgactgtacctgtaaagcatgtcattccagaaatcgttgcacattcgcattacactgtacaaggccaagacttcccagcaggtaatggttctagtgcatcagattactttaagttatctaatggtagtgacattgcagatgcaactattacatgggtaagtggacaagcgccaaataaagataatacacgtattggtgaagatataactgtaactgcacatatcttaattgatggcgaaacaacgccgattacgaaaacagcaacatataaagtagtaagaactgtaccgaaacatgtctttgaaacagccagaggtgttttatacccaggtgtttcagatatgtatgatgcgaaacaatatgttaagccagtaaataattcttggtcgacaaatgcgcaacatatgaatttccaatttgttggaacatatggtcctaacaaagatgttgtaggcatatctactcgtcttattagagtgacatatgataatagacaaacagaagatttaactattttatctaaagttaaacctgacccacctagaattgacgcaaactctgtgacatataaagcaggtcttacaaaccaagaaattaaagttaataacgtattaaataactcgtcagtaaaattatttaaagcagataatacaccattaaatgtcacaaatattactcatggtagcggttttagttcggttgtgacagtaagtgacgcgttaccaaatggcggaattaaagcaaaatcttcaatttcaatgaacaatgtgacgtatacgacgcaagacgaacatggtcaagttgttacagtaacaagaaatgaatctgttgattcaaatgacagtgcaacagtaacagtgacaccacaattacaagcaactactgaaggcgctgtatttattaaaggtggcgacggttttgatttcggacacgtagaaagatttattcaaaacccgccacatggggcaacggttgcatggcatgatagtccagatacatggaagaatacagtcggtaacactcataaaactgcggttgtaacattacctaatggtcaaggtacgcgtaatgttgaagttccagtcaaagtttatccagttgctaatgcaaaggcgccatcacgtgatgtgaaaggtcaaaatttgactaatggaacggatgcgatgaactacattacatttgatccaaatacaaacacaaatggtatcactgcagcatgggcaaatagacaacaaccaaataaccaacaagcaggcgtgcaacatttaaatgtcgatgtcacatatccaggtatttcagctgctaaacgagttcctgttactgttaatgtatatcaatttgaattccctcaaactacttatacgacaacggttggaggcactttagcaagtggtacgcaagcatcaggatatgcacatatgcaaaatgctactggtttaccaacagatggatttacgtataaatggaatcgtgatactacaggtacaaatgacgcaaactggtcagctatgaataaaccgaatgtggctaaagtcgttaacgcaaaatatgacgtcatctataacggacatacttttgcaacatctttaccagcgaaatttgtagtaaaagatgtgcaaccagcgaaaccaactgtgactgaaacagcggcaggagcgattacaattgcacctggagcaaaccaaacagtgaatacacatgccggtaacgtaacgacatacgctgataaattagttattaaacgtaatggtaacgttgtgacgacatttacacgtcgcaataatacgagtccatgggtgaaagaagcatctgcagcaactgtagcaggtattgctggaactaataatggtattactgttgcagcaggtactttcaaccctgctgatacaattcaagttgttgcaacgcaaggaagcggagagacagtgagtgatgagcaacgtagtgatgatttcacagttgtcgcaccacaaccgaaccaagcgactactaagatttggcaaaatggtcatattgatatcacgcctaataatccatcaggacatttaattaatccaactcaagcaatggatattgcttacactgaaaaagtgggtaatggtgcagaacatagtaagacaattaatgttgttcgtggtcaaaataatcaatggacaattgcgaataagcctgactatgtaacgttagatgcacaaactggtaaagtgacgttcaatgccaatactataaaaccaaattcatcaatcacaattactccgaaagcaggtacaggtcactcagtaagtagtaatccaagtacattaactgcaccggcagctcatactgtcaacacaactgaaattgtgaaagattatggttcaaatgtaacagcagctgaaattaacaatgcagttcaagttgctaataaacgtactgcaacgattaaaaatggcacagcaatgcctactaatttagctggtggtagcacaacgacgattcctgtgacagtaacttacaatgatggtagtactgaagaagtacaagagtccattttcacaaaagcggataaacgtgagttaatcacagctaaaaatcatttagatgatccagtaagcactgaaggtaaaaagccaggtacaattacgcagtacaataatgcaatgcataatgcgcaacaacaaatcaatactgcgaaaacagaagcacaacaagtgattaataatgagcgtgcaacaccacaacaagtttctgacgcactaactaaagttcgtgcagcacaaactaagattgatcaagctaaagcattacttcaaaataaagaagataatagccaattagtaacgtctaaaaataacttacaaagttctgtgaaccaagtaccatcaactgctggtatgacgcaacaaagtattgataactataatgcgaagaagcgtgaagcagaaactgaaataactgcagctcaacgtgttattgacaatggcgatgcaactgcacaacaaatttcagatgaaaaacatcgtgtcgataacgcattaacagcattaaaccaagcgaaacatgatttaactgcagatacacatgccttagagcaagcagtgcaacaattgaatcgcacaggtacaacgactggtaagaagccggcaagtattactgcttacaataattcgattcgtgcacttcaaagtgacttaacaagtgctaaaaatagcgctaatgctattattcaaaagccaataagaacagtacaagaagtgcaatctgcgttaacaaatgtaaatcgtgtcaatgagcgattaacgcaagcaattaatcaattagtacctttagctgataatagtgctttaaaaactgctaagacgaaacttgatgaagaaatcaataaatcagtaactactgatggtatgacacaatcatcaatccaagcatatgaaaatgctaaacgtgcgggtcaaacagaatcaacaaatgcacaaaatgttattaacaatggtgatgcgactgaccaacaaattgccgcagaaaaaacaaaagtagaagaaaaatataatagcttaaaacaagcaattgctggattaactccagacttggcaccattacaaactgcaaaaactcagttgcaaaatgatattgatcagccaacgagtacgactggtatgacaagcgcatctattgcagcatttaatgaaaaactttcagcagctagaactaaaattcaagaaattgatcgtgtattagcctcacatccagatgttgcgacaatacgtcaaaacgtgacagcagcgaatgccgctaaatcagcacttgatcaagcacgtaatggcttaacagtcgataaagcgcctttagaaaatgcgaaaaatcaactacaacatagtattgacacgcaaacaagtacaactggtatgacacaagactctataaatgcatacaatgcgaagttaacagctgcacgtaataagattcaacaaatcaatcaagtattagcaggttcaccgactgtagaacaaattaatacaaatacgtctacagcaaatcaagctaaatctgatttagatcatgcacgtcaagctttaacaccagataaagcgccgcttcaaactgcgaaaacgcaattagaacaaagcattaatcaaccaacggatacaacaggtatgacgaccgcttcgttaaatgcgtacaaccaaaaattacaagcagcgcgtcaaaagttaactgaaattaatcaagtgttgaatggcaacccaactgtccaaaatatcaatgataaagtgacagaggcaaaccaagctaaggatcaattaaatacagcacgtcaaggtttaacattagatagacagccagcgttaacaacattacatggtgcatctaacttaaaccaagcacaacaaaataatttcacgcaacaaattaatgctgctcaaaatcatgctgcgcttgaaacaattaagtctaacattacggctttaaatactgcgatgacgaaattaaaagacagtgttgcggataataatacaattaaatcagatcaaaattacactgacgcaacaccagctaataaacaagcgtatgataatgcagttaatgcggctaaaggtgtcattggagaaacgactaatccaacgatggatgttaacacagtgaaccaaaaagcagcatctgttaaatcgacgaaagatgctttagatggtcaacaaaacttacaacgtgcgaaaacagaagcaacaaatgcgattacgcatgcaagtgatttaaaccaagcacaaaagaatgcattaacacaacaagtgaatagtgcacaaaacgtgcaagcagtaaatgatattaaacaaacgactcaaagcttaaatactgctatgacaggtttaaaacgtggcgttgctaatcataaccaagtcgtacaaagtgataattatgtcaacgcagatactaataagaaaaatgattacaacaatgcatacaaccatgcgaatgacattattaatggtaatgcacaacatccagttataacaccaagtgatgttaacaatgctttatcaaatgtcacaagtaaagaacatgcattgaatggtgaagctaagttaaatgctgcgaaacaagaagcgaatactgcattaggtcatttaaacaatttaaataatgcacaacgtcaaaacttacaatcgcaaattaatggtgcgcatcaaattgatgcagttaatacaattaagcaaaatgcaacaaacttgaatagtgcaatgggtaacttaagacaagctgttgcagataaagatcaagtgaaacgtacagaagattatgcggatgcagatacagctaaacaaaatgcatataacagtgcagtttcaagtgccgaaacaatcattaatcaaacaacaaatccaacgatgtctgttgatgatgttaatcgtgcaacttcagctgttacttctaataaaaatgcattaaatggttatgaaaaattagcacaatctaaaacagatgctgcaagagcaattgatgcattaccacatttaaataatgcacaaaaagcagatgttaaatctaaaattaatgctgcatcaaatattgctggcgtaaatactgttaaacaacaaggtacagatttaaatacagcgatgggtaacttgcaaggtgcaatcaatgatgaacaaacgacgcttaatagtcaaaactatcaagatgcgacacctagtaagaaaacagcatacacaaatgcggtacaagctgcgaaagatattttaaataaatcaaatggtcaaaataaaacgaaagatcaagttactgaagcgatgaatcaagtgaattctgctaaaaataacttagatggtacgcgtttattagatcaagcgaagcaaacagcaaaacagcagttaaataatatgacgcatttaacaactgcacaaaaaacgaatttaacaaaccaaattaatagtggtactactgtcgctggtgttcaaacggttcaatcaaatgccaatacattagatcaagccatgaatacgttaagacaaagtattgccaacaaagatgcgactaaagcaagtgaagattacgtagatgctaataatgataagcaaacagcatataacaacgcagtagctgctgctgaaacgattattaatgctaatagtaatccagaaatgaatccaagtacgattacacaaaaagcagagcaagtgaatagttctaaaacggcacttaacggtgatgaaaacttagctgctgcaaaacaaaatgcgaaaacgtacttaaacacattgacaagtattacagatgctcaaaagaacaatttgattagtcaaattactagtgcgacaagagtgagtggtgttgatactgtaaaacaaaatgcgcaacatctagaccaagctatggctagcttacagaatggtattaacaacgaatctcaagtgaaatcatctgagaaatatcgtgatgctgatacaaataaacaacaagagtatgataatgctattactgcagcgaaagcgattttaaataaatcgacaggtccaaacactgcgcaaaatgcagttgaagcagcattacaacgtgttaataatgcgaaagatgcattgaatggtgatgcaaaattaattgcagctcaaaacgcagcgaaacaacatttaggtactttaacgcatatcactacagctcaacgtaatgatttaacaaatcaaatttcacaagctacaaacttagctggtgttgaatctgttaaacaaaatgcgaatagtttagatggtgctatgggtaacttacaaacggctatcaacgataagtcaggaacattagcgagccaaaacttcttggatgctgatgagcaaaaacgtaatgcatacaatcaagctgtatcagcagccgaaaccattttaaataaacaaactggaccgaatacagcgaaaacagcagtcgaacaagcacttaataatgttaataatgcgaaacatgcattaaatggtacgcaaaacttaaacaatgcgaaacaagcagcgattacagcaatcaatggcgcatctgatttaaatcaaaaacaaaaagatgcattaaaagcacaagctaatggtgctcaacgcgtatctaatgcacaagatgtacagcacaatgcgactgaactgaacacggcaatgggcacattaaaacatgccatcgcagataagacgaatacgttagcaagcagtaaatatgttaatgccgatagcactaaacaaaatgcttacacaactaaagttaccaatgctgaacatattattagcggtacgccaacggttgttacgacaccttcagaagtaacagctgcagctaatcaagtaaacagcgcgaaacaagaattaaatggtgacgaaagattacgtgaagcaaaacaaaacgccaatactgctattgatgcattaacacaattaaatacacctcaaaaagctaaattaaaagaacaagtgggacaagccaatagattagaagacgtacaaactgttcaaacaaatggacaagcattgaacaatgcaatgaaaggcttaagagatagtattgctaacgaaacaacagtcaaaacaagtcaaaactatacagacgcaagtccgaataaccaatcaacatataatagcgctgtgtcaaatgcgaaaggtatcattaatcaaactaacaatccgactatggatactagtgcgattacccaagctacaacacaagtgaataatgctaaaaatggtttaaacggtgctgaaaacttaagaaatgcacaaaacactgctaagcaaaacttaaatacattatcacacttaacaaataaccaaaaatctgccatctcatcacaaattgatcgtgcaggtcatgtgagtgaggtaactgctactaaaaatgcagcaactgagttgaatacgcaaatgggtaacttggaacaagctatccatgatcaaaacacagttaaacaaagtgttaaatttactgatgcagataaagctaaacgtgatgcgtatacaaatgcggtaagcagagctgaagcaattctgaataaaacgcaaggtgcaaatacgtctaaacaagatgttgaagcggctattcaaaatgtttcaagtgctaaaaatgcattgaatggtgatcaaaacgttacaaatgcgaagaatgcagctaaaaatgcattaaataacttaacgtcaattaataatgcacaaaaacgtgacttaacaactaaaattgatcaagcaacaactgtagctggtgttgaagctgtatctaatacgagtacacaattgaatacagcgatggctaacttgcaaaatggtattaatgataaaacaaatacactagcaagtgaaaactatcatgatgctgattcagataagaaaactgcttatactcaagccgttacgaacgcagaaaatattttaaataaaaatagtggatcaaatttagacaaaactgccgttgaaaacgcgttgtcacaagttgctaatgcgaaaggtgccctaaatggtaaccataatttagagcaagctaaatcaaatgcaaacactactataaacggacttcaacatttaacaactgctcaaaaagataaattgaaacaacaagtgcaacaagcacaaaatgttgcaggtgtagatactgttaaatcaagtgccaacacattaaatggtgctatgggtacgttaagaaatagcatacaagataacacagctacgaaaaatggccaaaactatcttgatgctacagaacgtaacaaaacaaactataacaatgctgttgatagtgctaatggtgtcattaatgcaacaagcaatccaaatatggatgctaatgcaattaaccaaatcgctacacaagtgacatcaacgaaaaatgcattagatggtacacataatttaacgcaagcgaaacaaacagcaacaaatgccatcgatggtgctactaacttaaataaagcgcaaaaagatgcgttaaaagcacaagttacaagtgcgcaacgtgttgcaaatgtaacaagtatccaacaaactgcaaatgaacttaatacagctatgggtcaattacaacatggtattgatgatgaaaatgcaacaaaacaaactcaaaaatatcgtgacgctgaacaaagtaagaaaactgcttatgatcaagctgtagctgctgcgaaagcaattttaaataaacaaacaggttcaaattcagataaagcagcagttgaccgtgcattacaacaagtaacaagtacgaaagatgcattgaatggtgatgcaaaactggcagaagcgaaagcggcagctaaacaaaacttaggcactttaaaccatattacgaatgcacaacgtactgacttagaaggccaaatcaatcaagcgacgactgttgatggcgttaatactgtaaaaacaaatgccaatacattagacggcgcaatgaatagcttacaaggttcaatcaatgataaagatgcgacattaagaaatcaaaattatcttgatgcggatgaatcaaaacgaaatgcatatacgcaagctgtcacagcggctgaaggcattttaaataaacaaactggtggtaacacatctaaagcagacgttgataatgcattaaatgcagttacaagagcgaaagcggctttaaatggtgctgacaacttaagaaatgcgaaaacttcagcaacaaatacgattgatggtttacctaacttaacacaattacaaaaagacaacttgaagcatcaagttgaacaagcgcaaaatgtagcaggtgtaaatggtgttaaagataaaggtaatacgttaaatactgccatgggtgcattacgtacaagtatccaaaatgataatacgacgaaaacaagtcaaaattatcttgatgcatctgacagcaacaaaaataattacaatactgctgtaaataatgcaaatggtgttattaatgcaacgaacaatccaaatatggatgctaatgcgattaatggcatggcaaatcaagtcaatacaacaaaagcagcgttaaatggtgcacaaaacttagctcaagctaaaacaaatgcgacgaacacaattaacaacgcacatgacttaaaccaaaaacaaaaagatgcattaaaaacacaagttaacaatgcacaacgtgtatctgatgcaaataacgttcaacacactgcaactgaattgaacagtgcgatgacagcacttaaagcagctattgctgataaagaaagaacaaaagcaagcggtaattatgtcaatgctgatcaagaaaaacgtcaagcgtatgattcaaaagtgactaacgctgaaaatatcattagtggtacaccgaatgcgacattaacagtcaatgacgtaaatagtgcggcatcacaagtcaatgcggctaaaacagcattaaatggtgataacaacttacgtgtagcgaaagagcatgccaacaatacaattgacggcttagcacaattgaataatgcacaaaaagcaaaattaaaagaacaagttcaaagtgcaactacattagatggtgttcaaactgttaaaaatagttctcaaacgttgaatacagcgatgaaaggcttaagagatagtattgcgaatgaagcaacaattaaagcaggtcaaaactacactgacgcaagtccaaataatcgtaacgagtacgacagtgcagttactgcagcaaaagcaatcattaatcaaacatcgaacccaacgatggaaccaaatactattacgcaagtaacatcacaagtgacaactaaagaacaggcattaaatggtgcgcgaaacttagctcaagctaagacaactgcgaaaaacaacttgaataacttaacatcaattaacaatgcacaaaaagatgcgttaacgcgtagcattgatggtgcaacaacagtagctggtgtaaatcaagaaactgcaaaagcaacagaattaaataacgcaatgcatagtttacaaaatggtatcaatgatgagacacaaacaaaacaaactcagaaatacctagatgcagagccaagtaagaaatcagcttatgatcaagcagtaaatgcagcgaaagcaattttaacaaaagctagtggtcaaaatgtagacaaagcagcagttgaacaagcattgcaaaatgtgaacagtacgaagacggcgttgaacggtgatgcgaaattaaatgaagctaaagcagctgcgaaacaaacgttaggtacattaacacacattaataatgcacaacgtacagcgttagacaatgaaattacacaagcaacaaatgttgaaggtgttaatacagttaaagccaaagcgcaacaattagatggtgctatgggtcaattagaaacatcaattcgtgataaagacacgacgttacaaagtcaaaattatcaagatgctgatgatgctaaacgaactgcttattctcaagcagtaaatgcagcagcaactattttaaataaaacagctggcggtaatacacctaaagcagatgttgaaagagcaatgcaagctgttacacaagcaaatactgcattaaacggtattcaaaacttagatcgtgcgaaacaggctgctaacacagcgattacaaatgcttcggacttaaatacaaaacaaaaagaagcattaaaagcacaagtaacaagtgcaggacgtgtatctgcagcaaatggtgttgaacatactgcgactgaattaaatactgcgatgacagctttaaagcgtgccattgctgataaagctgagacaaaagctagtggtaactatgtcaatgctgatgcgaataaacgtcaagcatatgatgaaaaagttacagctgccgaaaatatcgttagtggtacaccaacaccaacgttaacaccagcagatgttacaaatgcagcaacgcaagtaacgaatgctaagacgcagttaaacggtaatcataatttagaagtagcgaaacaaaatgctaacactgcaattgatggtttaacttctttaaatggtccgcaaaaagcaaaacttaaagaacaagtgggtcaagcgacgacgttgccaaatgttcaaactgttcgtgataatgcacaaacattaaacactgcaatgaaaggtctacgagatagcattgcgaatgaagcaacgattaaagcaggtcaaaactacacagatgcaagtcaaaacaaacaaactgactacaacagtgcagtcactgcagcaaaagcaatcattggtcaaacaactagtccatcaatgaatgcgcaagaaattaatcaagcgaaagaccaagtgacagctaaacaacaagcgttaaacggtcaagaaaacttaagaactgcgcaaacaaatgcgaagcaacatttgaacggcttaagtgacttaactgacgctcaaaaagatgcagtgaaacgtcaaatcgaaggtgcaacgcatgttaatgaagtaacacaagcacaaaataatgcggatgcattaaatacagctatgacgaacttgaaaaatggtattcaagatcagaatacgattaagcaaggtgttaacttcactgatgccgacgaagcgaaacgtaatgcatatacaaatgcagtgacgcaagctgaacaaattttaaataaagcacaaggtccaaatacttcaaaagacggtgtcgaaactgcgttagaaaatgtacaacgtgctaaaaacgaattgaacggtaatcaaaatgttgcgaacgctaagacaactgcgaaaaatgcattgaataacctaacatcaattaataatgcacaaaaagaagcattgaaatcacaaattgaaggtgcgacaacagttgcaggtgtaaatcaagtgtctacaacggcatctgaattaaatacagcaatgagcaacttacaaaatggtattaatgatgaagcagctacaaaagcagcgcttaatggtactcaaaaccttgaaaaagctaaacaacacgcaaatacagcaattgacggtttaagccatttaacaaatgcacaaaaagaggcattaaaacaattggtacaacaatcgactactgttgcagaagcacaaggtaatgagcaaaaagcaaacaatgttgatgcagcaatggacaaattacgtcaaagtattgcagataatgcgacaacaaaacaaaaccaaaattatactgatgcaagtcagaataaaaaggatgcgtacaataatgctgtcacaactgcacaaggtattattgatcaaactacaagtccaactttagatccgactgttatcaatcaagctgctggacaagtaagcacaactaaaaatgcattaaatggtaatgaaaacctagaggcagcgaaacaacaagcgtcacaatcattaggttcattagataacttaaataatgcgcaaaaacaaacagttactgatcaaattaatggcgcgcatactgttgatgaagcaaatcaaattaagcaaaatgcgcaaaacttaaatacagcgatgggtaacttgaaacaagcgatagctgacaaagatgctacgaaagcgacagttaacttcactgatgcagatcaagcaaaacaacaagcatataacactgctgttacaaatgctgaaaatatcatttcaaaagctaatggcggcaatgcaacacaagctgaagttgaacaagcaatcaaacaagttaatgctgcaaaacaagcattaaatggtaatgccaacgttcaacatgcaaaagacgaagcaacagcattaattaatagctctaatgaccttaaccaagcacaaaaagacgcattaaaacaacaagttcaaaatgcaactactgtagctggtgtaaacaatgttaaacaaacagcacaagagttaaacaatgctatgacacaattaaaacaaggcattgcagataaagaacaaacaaaagctgatggtaactttgtcaatgcagatcctgataagcaaaatgcatataatcaagcagtagcgaaagctgaagcattaattagtgctacgcctgatgttgtcgttacacctagcgaaattactgcagcgttaaataaagttacgcaagctaaaaatgatttaaatggtaatacaaacttagcaacggcgaaacaaaatgttcaacatgctattgatcaattgccaaacttaaaccaagcgcaacgtgatgaatacagcaaacaaatcacgcaagcaacacttgtaccaaacgtcaatgctattcaacaagcggcgacaacgcttaatgacgcgatgacacaattgaaacaaggtattgcgaataaagcacaaattaaaggtagcgagaactatcacgatgctgatactgacaagcaaacagcatatgataatgcagtaacaaaagcagaagaattgttaaaacaaacaacaaatccaacaatggatccaaatacaattcaacaagcattaactaaagtgaatgacacaaatcaagcacttaacggtaatcaaaaattagctgatgccaaacaagatgctaagacaacacttggtacactagatcatttaaatgatgctcaaaaacaagcgctaacaactcaagttgaacaagcaccagatattgcaacagttaataatgttaagcaaaatgctcaaaatctgaataatgctatgactaacttaaacaatgcattacaagataaaactgagacattaaatagcattaactttactgatgcagatcaagctaagaaagatgcttatactaatgcggtttcacatgcagaaggtattttatctaaagcaaatggcagcaatgcaagtcaaactgaagtggaacaagcgatgcaacgtgtgaacgaagcgaaacaagcattgaatggtaatgacaatgtacaacgtgcaaaagatgcagcgaaacaagtgattacaaatgcaaatgatttaaatcaagcaatgacacaattgaaacaaggtattgcagataaagaccaaactaaagcaaatggtaactttgtcaatgctgatactgataagcaaaatgcttacaacaatgcggtagcacatgctgaacaaataattagtggtacaccaaatgcaaacgtggatccacaacaagtggctcaagcgttacaacaagtgaatcaagctaagggtgatttaaacggtaaccataacttacaagttgctaaagacaatgcaaatacagccattgatcagttaccaaacttaaatcaaccacaaaaaacagcattaaaagaccaagtgtcgcatgcagaacttgttacaggtgttaatgctattaagcaaaatgctgatgcgttaaataatgcaatgggtacattgaaacaacaaattcaagcgaacagtcaagtaccacagtcagttgactttacacaagcggatcaagacaaacaacaagcatataacaatgcggctaaccaagcgcaacaaatcgcaaatggcataccaacacctgtattgacgcctgatacagtaacacaagcagtgacaactatgaatcaagcgaaagatgcattaaacggtgatgaaaaattagcacaagcgaaacaagaagctttagcaaatcttgatacgttacgcgatttaaatcaaccacaacgtgatgcattacgtaaccaaatcaatcaagcacaagcgttagctacagttgaacaaactaaacaaaatgcacaaaatgtgaatacagcaatgagtaacttgaaacaaggtattgcaaacaaagatactgtcaaagcaagtgagaactatcatgatgctgatgccgataagcaaacagcatatacaaatgcagtgtctcaagcggaaggtattatcaatcaaacgacaaatccaacgcttaacccagatgaaataacacgtgcattaactcaagtgactgatgctaaaaatggcttaaacggtgaagctaaattggcaactgaaaagcaaaatgctaaagatgccgtaagtgggatgacgcatttaaacgatgctcaaaaacaagcattaaaaggtcaaatcgatcaatcgcctgaaattgctacagtgaaccaagttaaacaaacagcaacgagcctagatcaagcaatggatcaattatcacaagctattaatgataaagctcaaacattagcggacggtaattacttaaatgcagatcctgacaaacaaaatgcgtataaacaggcagtagcaaaagctgaagcattattgaataaacaaagtggtactaatgaagtacaagcacaagttgaaagcatcactaatgaagtgaacgcagcgaaacaagcattaaatggtaatgacaatttggcaaatgcaaaacaacaagcaaaacaacaattggcgaacttaacacacttaaatgatgcacaaaaacaatcatttgaaagtcaaattacacaagcgccacttgttacagatgtcactacgattaatcaaaaagcacaaacgttagatcatgcgatggaattattaagaaatagtgttgcggataatcaaacgacattagcgtctgaagattatcatgatgcaactgcgcaaagacaaaatgactataaccaagctgtaacagctgctaataatataattaatcaaactacatcgcctacgatgaatccagatgatgttaatggtgcaacgacacaagtgaataatacgaaagttgcattagatggtgatgaaaaccttgcagcagctaaacaacaagcaaacaacagacttgatcaattagatcatttgaataatgcgcaaaagcaacagttacaatcacaaattacgcaatcatctgatattgctgcagttaatggtcacaaacaaacagcagaatctttaaatactgcgatgggtaacttaattaatgcgattgcagatcatcaagccgttgaacaacgtggtaacttcatcaatgctgatactgataaacaaactgcttataatacagcggtaaatgaagcagcagcaatgattaacaaacaaactggtcaaaatgcgaaccaaacagaagtagaacaagctattactaaagttcaaacaacacttcaagcgttaaatggagaccataatttacaagttgctaaaacaaatgcgacgcaagcaattgatgctttaacaagcttaaatgatcctcaaaaaacagcattaaaagaccaagttacagctgcaactttagtaactgcagttcatcaaattgaacaaaatgcgaatacgcttaaccaagcaatgcatggtttaagacagagcattcaagataacgcagcaactaaagcaaatagcaaatatatcaacgaagatcaaccagagcaacaaaactatgatcaagctgttcaagccgcaaataatattatcaatgaacaaactgcaacattagataataatgcgattaatcaagcagcgacaactgtgaatacaacgaaagcagcattacatggtgatgtgaagttacaaaatgataaagatcatgctaagcaaacggttagtcaattagcacatctaaacaatgcacaaaaacatatggaagatacgttaattgatagtgaaacaactagaacagcagttaagcaagatttgactgaagcacaagcattagatcaacttatggatgcattacaacaaagtattgctgacaaagatgcaacacgtgcgagcagtgcatatgtcaatgcagaaccgaataaaaaacaatcctatgatgaagcagttcaaaatgctgagtctatcattgcaggattaaataatccaactatcaataaaggtaatgtatcaagtgcgactcaagcagtaatatcatctaaaaatgcattagatggtgttgaacgattagctcaagataagcaaactgctggaaattctctaaatcatttagatcaattaacaccagctcaacaacaagcgctagaaaatcaaattaataatgcaacaactcgtgataaagtggctgaaatcattgcacaagcgcaagcattaaatgaagcgatgaaagcattaaaagaaagtattaaggatcaaccacaaactgaagcaagtagtaaatttattaacgaggatcaagcgcaaaaagatgcttatacgcaagcagtacaacacgcgaaagatttgattaacaaaacaactgatcctacattagctaaatcaatcattgatcaagcgacacaggcagtgacagatgctaaaaacaatttacatggtgatcaaaaactagctcaagataagcaacgtgcaacagaaacgttaaataacttgtctaacttgaatacaccacaacgtcaagcacttgaaaatcaaattaataatgcagcaactcgtggcgaagtagcacaaaaattaactgaagcacaagcacttaaccaagcaatggaagctttacgtaatagcattcaagatcaacagcaaacggaagcgggtagcaagtttatcaatgaagataaaccacaaaaagatgcttaccaagcagcagttcaaaatgcaaaagatttaattaatcaaactaacaatccaacgcttgataaagcacaagttgaacaattgacacaagctgttaaccaagctaaagataacctacacggtgatcaaaaacttgcagacgataaacaacatgcggttactgatttaaatcaattaaatggtttgaataatccgcaacgtcaagcacttgaaagccaaataaacaacgcagcaactcgtggcgaagtagcacaaaaattagctgaagcaaaagcgcttgatcaagcaatgcaagcattacgtaatagtattcaagatcaacaacaaacagaatctggtagcaagtttatcaatgaagataaaccgcaaaaagatgcttaccaagcagcagttcaaaatgcaaaagatttaattaaccaaacaggtaatccaacactcgacaaatcacaagtagaacaattgacacaagcagtaacaactgcaaaagataatctacatggtgatcaaaaacttgctcgtgatcaacaacaagcagtaacaactgtaaatgcattgccaaacttaaatcatgcacaacaacaagcattaactgatgctataaatgcagcgcctacaagaacagaggttgcacaacatgttcaaactgctactgaacttgatcacgcgatggaaacattgaaaaataaagttgatcaagtgaatacagataaggctcaaccaaattacactgaagcgtcaactgataaaaaagaagcagtagatcaagcgttacaagctgcagaaagcattacagatccaactaatggttcaaatgcgaataaagacgctgtagaccaagtattaactaagcttcaagaaaaagaaaatgagttaaatggtaatgagagagtcgctgaagctaaaacacaagcgaaacaaactattgaccaattaacacatttaaatgctgatcaaattgcaactgctaaacaaaacattgatcaagcgacgaaacttcaaccaattgctgaattagtagatcaagcaacgcaattgaatcaatctatggatcaattacaacaagcagttaatgaacatgctaacgttgagcaaactgtagattacacacaagcagattcagataaacaaaatgcttataaacaagctattgctgatgctgaaaatgtattgaaacaaaatgcgaataagcaacaagtggatcaagcacttcaaaatattttaaatgcaaaacaagcattaaatggtgatgaacgtgtagcacttgctaaaacaaatggtaaacatgacatcgaccaattgaatgcattaaacaatgctcaacaagatggatttaaaggtcgcatcgatcaatcaaacgatttaaatcaaatccaacaaattgtagatgaggctaaggcacttaatcgtgcaatggatcaattgtcacaagaaatcactgacaatgaaggacgcacgaaaggtagcacgaactatgtcaatgcagatacacaagtcaaacaagtatatgatgaaacggttgataaagcgaaacaagcacttgataaatcgactggtcaaaacttaactgcaaaacaagttatcaaattaaatgatgcagtcactgcagctaagaaagcattaaatggtgaagaaagacttaataatcgtaaagctgaagcattacaaagattggatcaattaacacatctaaacaatgctcaaagacaattagcaatccaacaaattaataatgctgaaacgctaaataaagcatctcgagcaattaatagagcaactaaattagataatgcaatgggttcagtacaacaatatattgacgaacagcaccttggtgttatcagcagcacaaattacatcaatgcagatgacaatttgaaagcaaattatgataatgcaattgcgaatgcagcacatgagttagataaagtgcaaggtaatgcaattgcaaaagctgaagcagagcaattgaaacaaaatattatcgatgctcaaaatgcattaaatggagaccaaaaccttgcaaatgccaaagataaagcaaatgcgtttgttaattcgttaaatggattaaatcaacagcaacaagatcttgcacataaagcaattaacaatgccgatactgtatcagatgtaacagatattgttaataatcaaattgacttaaatgatgcaatggaaacattgaaacatttagttgacaatgaaattccaaatgcagagcaaactgtcaattaccaaaacgctgacgataatgctaaaacaaacttcgatgatgccaaacgtctagcaaatacattgctaaatagtgataacacaaatgtgaatgatatcaatggcgcaatccaagcagtcaatgatgcaatccataatcttaatggtgatcaacgactacaagatgctaaagacaaggcaattcaatctattaatcaagctttagctaataagctaaaagaaatcgaagcttcaaatgcgacggatcaagacaagcttattgcgaaaaataaagcagaagaattggcaaacagcatcatcaacaacattaataaagcaacaagtaatcaggctgtatctcaagttcaaacagcaggcaaccacgcgattgaacaagtgcatgccaatgaaataccaaaagcaaaaattgatgccaataaagacgttgataagcaagttcaagcattaattgacgaaattgatcgaaatccaaatctaacagataaggaaaaacaagcacttaaagatcgtattaatcaaatacttcaacaaggtcataacggcattaacaatgcgatgactaaagaagaaattgaacaagccaaagcacaacttgcgcaagcattacaagacatcaaagatttagtgaaagctaaagaagatgcgaaacaagatgttgataaacaagttcaagctttaattgacgaaatcgatcaaaatccaaatctaacagataaggaaaaacaagcacttaaagatcgtattaatcaaatacttcaacaaggtcataacgacattaacaatgcgatgacaaaagaagcaattgaacaagcaaaagaacgtttagcgcaagcattgcaagacatcaaagatttagtgaaagctaaagaagatgcgaaaaatgatattgataaacgtgtacaagctttaattgacgaaatcgatcaaaatccaaatctaacagataaggaaaaacaagcacttaaagatcgaattaatcaaatacttcaacaaggtcataacgacattaacaatgcgctgactaaagaagaaattgagcaggcaaaagcacaacttgcacaagcattgcaagacatcaaagatttagtgaaagctaaagaagatgcgaaaaatgcaataaaagccttagctaatgcgaagcgtgatcaaatcaattcaaatccagatttaacacctgagcaaaaagcaaaagcgctcaaagaaattgacgaagctgaaaaacgagcactacaaaacgttgagaatgctcaaactatagatcaattaaatcgaggattaaacttaggtttagatgacattagaaatacacatgtatgggaggttgatgaacaacctgctgtaaatgaaatttttgaagcaacacctgagcaaatcctagttaatggtgaactcattgtacatcgtgatgacatcattacagaacaagatattcttgcacacataaacttaattgatcagctttcagcagaagtcatcgatacaccatcaactgcaacgatttctgatagcttaacagcaaaagttgaagttacattgcttgatggatcaaaagtgattgttaatgttcctgtaaaagttgtagaaaaagaattgtcagtagtcaaacaacaggcaattgaatcaatcgaaaatgcggcacaacaaaagattaatgaaatcaataatagtgtgacattaacactggaacaaaaagaagctgcaattgcagaagttaataagcttaaacaacaagcaattgatcatgttaacaatgcacctgatgttcattcagttgaagaaattcaacaacaagaacaagcgcatattgaacaatttaatccagaacaatttacgattgaacaagcaaaatcaaatgcaattaaatcgattgaagatgcaattcaacatatgattgatgaaatcaaagctcgtactgatctaacagataaagagaagcaagaagctattgctaagttaaatcaattaaaagaacaagcaattcaagcgattcaacgtgcgcaaagcatcgatgaaataagtgagcaattggaacaatttaaagctcaaatgaaagcagctaatccaacagcaaaagaactagctaaacgcaagcaagaagctattagtagaattaaagacttttcaaatgaaaaaataaatagtattcgaaatagtgaaattggcacagctgatgaaaaacaagcagcaatgaatcaaattaacgaaattgtgcttgaaacaattagagatattaataatgcgcatacattacagcaagttgaggctgcattgaacaatggtattgctcgaatttcagcagtacaaattgtaacatctgatcgtgctaaacaatcgtcaagtactggaaatgaatctaatagccatttaacaattggttatggaactgcaaatcatccatttaacagttcgactattggacataaaaagaaacttgatgaagatgatgacattgatccacttcatatgcgtcactttagtaataatttcggtaatgttattaaaaacgctattggtgtggtgggtatctctggtttactagctagtttctggttcttcattgccaaacgtcgtcgtaaagaagatgaagaggaagaattagaaataagagataataataaagattcaataaaagagactttagacgatacaaaacatttaccacttttatttgcgaaacgtcgcagaaaagaagatgaagaagatgttactgttgaagaaaaagattcgctaaataatggcgagtcactcgataaagttaaacatacgccgttcttcttaccaaaacgtcgtcgtaaagaagatgaagaagatgtggaagttacaaatgaaaacacagatgaaaaagtgttgaaagataacgaacattcaccactcttattcgcaaaacgacgcaaagataaagaggaagatgttgaaacaacaactagtattgaatctaaagatgaggacgttcctttattattggctaaaaagaaaaatcaaaaagataaccaatccaaagacaaaaagtcagcatcaaaaaatacttctaaaaaggtagcagctaaaaagaagaaaaagaaagctaagaaaaataaaaaa

SEQ ID NO: 4496 - protein, 9535 aa, Staphylococcus aureus
  MISC_FEATURE (1)..(9535): hypothetical protein
VNYRDKIQKFSIRKYTVGTFSTVIATLVFLGFNTSQAHAAETNQPASVVKQKQQSNNEQTENRESQVQNSQNSQNGQSLSATHENEQPNISQANLVDQKVAQSSTTNDEQPASQNVNTKKDSATAATTQPDKEQSKHKQNESQSANKNGNDNRAAHVENHEANVVTASDSSDNGNVQHDRNELQAFFDANYHDYRFIDRENADSGTFNYVKGIFDKINTLLGSNDPINNKDLQLAYKELEQAVALIRTMPQRQQTSRRSNRIQTRSVESRAAEPRSVSDYQNANSSYYVENANDGSGYPVGTYINASSKGAPYNLPTTPWNTLKASDSKEIALMTAKQTGDGYQWVIKFNKGHAPHQNMIFWFALPADQVPVGRTDFVTVNSDGTNVQWSHGAGAGANKPLQQMWEYGVNDPHRSHDFKIRNRSGQVIYDWPTVHIYSLEDLSRASDYFSEAGATPATKAFGRQNFEYINGQKPAESPGVPKVYTFIGQGDASYTISFKTQGPTVNKLYYAAGGRALEYNQLFMYSQLYVESTQDHQQRLNGLRQVVNRTYRIGTTKRVEVSQGNVQTKKVLESTNLNIDDFVDDPLSYVKTPSNKVLGFYSNNANTNAFRPGGAQQLNEYQLSQLFTDQKLQEAARTRNPIRLMIGFDYPDAYGNSETLVPVNLTVLPEIQHNIKFFKNDDTQNIAEKPFSKQAGHPVFYVYAGNQGNASVNLGGSVTSIQPLRINLTSNENFTDKDWQITGIPRTLHIENSTNRPNNARERNIELVGNLLPGDYFGTIRFGRKEQLFEIRVKPHTPTITTTAEQLRGTALQKVPVNISGIPLDPSALVYLVAPTNQTTNGGSEADQIPSGYTILATGTPDGVHNTITIRPQDYVVFIPPVGKQIRAVVYYNKVVASNMSNAVTILPDDIPPTINNPVGINAKYYRGDEVNFTMGVSDRHSGIKNTTITTLPNGWTSNLTKADKNNGSLSITGRVSMNQAFNSDITFKVSATDNVNNTTNDSQSKHVSIHVGKISEDAHPIVLGNTEKVVVVNPTAVSNDEKQSIITAFMNKNQNIRGYLASTDPVTVDNNGNVTLHYRDGSSTTLDATNVMTYEPVVKPEYQTVNAAKTATVTIAKGQSFSIGDIKQYFTLSNGQPIPSGTFTNITSDRTIPTAQEVSQMNAGTQLYHITATNAYHKDSEDFYISLKIIDVKQPEGDQRVYRTSTYDLTTDEISKVKQAFINANRDVITLAEGDISVTNTPNGANVSTITVNINKGRLTKSFASNLANMNFLRWVNFPQDYTVTWTNAKIANRPTDGGLSWSDDHKSLIYRYDATLGTQITTNDILTMLKATTTVPGLRNNITGNEKSQAEAGGRPNFRTTGYSQSNATTDGQRQFTLNGQVIQVLDIINPSNGYGGQPVTNSNTRANHSNSTVVNVNEPAANGAGAFTIDHVVKSNSTHNASDAVYKAQLYLTPYGPKQYVEHLNQNTGNTTDAINIYFVPSDLVNPTISVGNYTNHQVFSGETFTNTITANDNFGVQSVTVPNTSQITGTVDNNHQHVSATAPNVTSATNKTINLLATDTSGNTATTSFNVTVKPLRDKYRVGTSSTAANPVRIANISNNATVSQADQTTIINSLTFTETVPNRSYARASANEITSKTVSNVSRTGNNANVTVTVTYQDGTTSTVTVPVKHVIPEIVAHSHYTVQGQDFPAGNGSSASDYFKLSNGSDIADATITWVSGQAPNKDNTRIGEDITVTAHILIDGETTPITKTATYKVVRTVPKHVFETARGVLYPGVSDMYDAKQYVKPVNNSWSTNAQHMNFQFVGTYGPNKDVVGISTRLIRVTYDNRQTEDLTILSKVKPDPPRIDANSVTYKAGLTNQEIKVNNVLNNSSVKLFKADNTPLNVTNITHGSGFSSVVTVSDALPNGGIKAKSSISMNNVTYTTQDEHGQVVTVTRNESVDSNDSATVTVTPQLQATTEGAVFIKGGDGFDFGHVERFIQNPPHGATVAWHDSPDTWKNTVGNTHKTAVVTLPNGQGTRNVEVPVKVYPVANAKAPSRDVKGQNLTNGTDAMNYITFDPNTNTNGITAAWANRQQPNNQQAGVQHLNVDVTYPGISAAKRVPVTVNVYQFEFPQTTYTTTVGGTLASGTQASGYAHMQNATGLPTDGFTYKWNRDTTGTNDANWSAMNKPNVAKVVNAKYDVIYNGHTFATSLPAKFVVKDVQPAKPTVTETAAGAITIAPGANQTVNTHAGNVTTYADKLVIKRNGNVVTTFTRRNNTSPWVKEASAATVAGIAGTNNGITVAAGTFNPADTIQVVATQGSGETVSDEQRSDDFTVVAPQPNQATTKIWQNGHIDITPNNPSGHLINPTQAMDIAYTEKVGNGAEHSKTINVVRGQNNQWTIANKPDYVTLDAQTGKVTFNANTIKPNSSITITPKAGTGHSVSSNPSTLTAPAAHTVNTTEIVKDYGSNVTAAEINNAVQVANKRTATIKNGTAMPTNLAGGSTTTIPVTVTYNDGSTEEVQESIFTKADKRELITAKNHLDDPVSTEGKKPGTITQYNNAMHNAQQQINTAKTEAQQVINNERATPQQVSDALTKVRAAQTKIDQAKALLQNKEDNSQLVTSKNNLQSSVNQVPSTAGMTQQSIDNYNAKKREAETEITAAQRVIDNGDATAQQISDEKHRVDNALTALNQAKHDLTADTHALEQAVQQLNRTGTTTGKKPASITAYNNSIRALQSDLTSAKNSANAIIQKPIRTVQEVQSALTNVNRVNERLTQAINQLVPLADNSALKTAKTKLDEEINKSVTTDGMTQSSIQAYENAKRAGQTESTNAQNVINNGDATDQQIAAEKTKVEEKYNSLKQAIAGLTPDLAPLQTAKTQLQNDIDQPTSTTGMTSASIAAFNEKLSAARTKIQEIDRVLASHPDVATIRQNVTAANAAKSALDQARNGLTVDKAPLENAKNQLQHSIDTQTSTTGMTQDSINAYNAKLTAARNKIQQINQVLAGSPTVEQINTNTSTANQAKSDLDHARQALTPDKAPLQTAKTQLEQSINQPTDTTGMTTASLNAYNQKLQAARQKLTEINQVLNGNPTVQNINDKVTEANQAKDQLNTARQGLTLDRQPALTTLHGASNLNQAQQNNFTQQINAAQNHAALETIKSNITALNTAMTKLKDSVADNNTIKSDQNYTDATPANKQAYDNAVNAAKGVIGETTNPTMDVNTVNQKAASVKSTKDALDGQQNLQRAKTEATNAITHASDLNQAQKNALTQQVNSAQNVQAVNDIKQTTQSLNTAMTGLKRGVANHNQVVQSDNYVNADTNKKNDYNNAYNHANDIINGNAQHPVITPSDVNNALSNVTSKEHALNGEAKLNAAKQEANTALGHLNNLNNAQRQNLQSQINGAHQIDAVNTIKQNATNLNSAMGNLRQAVADKDQVKRTEDYADADTAKQNAYNSAVSSAETIINQTTNPTMSVDDVNRATSAVTSNKNALNGYEKLAQSKTDAARAIDALPHLNNAQKADVKSKINAASNIAGVNTVKQQGTDLNTAMGNLQGAINDEQTTLNSQNYQDATPSKKTAYTNAVQAAKDILNKSNGQNKTKDQVTEAMNQVNSAKNNLDGTRLLDQAKQTAKQQLNNMTHLTTAQKTNLTNQINSGTTVAGVQTVQSNANTLDQAMNTLRQSIANKDATKASEDYVDANNDKQTAYNNAVAAAETIINANSNPEMNPSTITQKAEQVNSSKTALNGDENLAAAKQNAKTYLNTLTSITDAQKNNLISQITSATRVSGVDTVKQNAQHLDQAMASLQNGINNESQVKSSEKYRDADTNKQQEYDNAITAAKAILNKSTGPNTAQNAVEAALQRVNNAKDALNGDAKLIAAQNAAKQHLGTLTHITTAQRNDLTNQISQATNLAGVESVKQNANSLDGAMGNLQTAINDKSGTLASQNFLDADEQKRNAYNQAVSAAETILNKQTGPNTAKTAVEQALNNVNNAKHALNGTQNLNNAKQAAITAINGASDLNQKQKDALKAQANGAQRVSNAQDVQHNATELNTAMGTLKHAIADKTNTLASSKYVNADSTKQNAYTTKVTNAEHIISGTPTVVTTPSEVTAAANQVNSAKQELNGDERLREAKQNANTAIDALTQLNTPQKAKLKEQVGQANRLEDVQTVQTNGQALNNAMKGLRDSIANETTVKTSQNYTDASPNNQSTYNSAVSNAKGIINQTNNPTMDTSAITQATTQVNNAKNGLNGAENLRNAQNTAKQNLNTLSHLTNNQKSAISSQIDRAGHVSEVTATKNAATELNTQMGNLEQAIHDQNTVKQSVKFTDADKAKRDAYTNAVSRAEAILNKTQGANTSKQDVEAAIQNVSSAKNALNGDQNVTNAKNAAKNALNNLTSINNAQKRDLTTKIDQATTVAGVEAVSNTSTQLNTAMANLQNGINDKTNTLASENYHDADSDKKTAYTQAVTNAENILNKNSGSNLDKTAVENALSQVANAKGALNGNHNLEQAKSNANTTINGLQHLTTAQKDKLKQQVQQAQNVAGVDTVKSSANTLNGAMGTLRNSIQDNTATKNGQNYLDATERNKTNYNNAVDSANGVINATSNPNMDANAINQIATQVTSTKNALDGTHNLTQAKQTATNAIDGATNLNKAQKDALKAQVTSAQRVANVTSIQQTANELNTAMGQLQHGIDDENATKQTQKYRDAEQSKKTAYDQAVAAAKAILNKQTGSNSDKAAVDRALQQVTSTKDALNGDAKLAEAKAAAKQNLGTLNHITNAQRTDLEGQINQATTVDGVNTVKTNANTLDGAMNSLQGSINDKDATLRNQNYLDADESKRNAYTQAVTAAEGILNKQTGGNTSKADVDNALNAVTRAKAALNGADNLRNAKTSATNTIDGLPNLTQLQKDNLKHQVEQAQNVAGVNGVKDKGNTLNTAMGALRTSIQNDNTTKTSQNYLDASDSNKNNYNTAVNNANGVINATNNPNMDANAINGMANQVNTTKAALNGAQNLAQAKTNATNTINNAHDLNQKQKDALKTQVNNAQRVSDANNVQHTATELNSAMTALKAAIADKERTKASGNYVNADQEKRQAYDSKVTNAENIISGTPNATLTVNDVNSAASQVNAAKTALNGDNNLRVAKEHANNTIDGLAQLNNAQKAKLKEQVQSATTLDGVQTVKNSSQTLNTAMKGLRDSIANEATIKAGQNYTDASPNNRNEYDSAVTAAKAIINQTSNPTMEPNTITQVTSQVTTKEQALNGARNLAQAKTTAKNNLNNLTSINNAQKDALTRSIDGATTVAGVNQETAKATELNNAMHSLQNGINDETQTKQTQKYLDAEPSKKSAYDQAVNAAKAILTKASGQNVDKAAVEQALQNVNSTKTALNGDAKLNEAKAAAKQTLGTLTHINNAQRTALDNEITQATNVEGVNTVKAKAQQLDGAMGQLETSIRDKDTTLQSQNYQDADDAKRTAYSQAVNAAATILNKTAGGNTPKADVERAMQAVTQANTALNGIQNLDRAKQAANTAITNASDLNTKQKEALKAQVTSAGRVSAANGVEHTATELNTAMTALKRAIADKAETKASGNYVNADANKRQAYDEKVTAAENIVSGTPTPTLTPADVTNAATQVTNAKTQLNGNHNLEVAKQNANTAIDGLTSLNGPQKAKLKEQVGQATTLPNVQTVRDNAQTLNTAMKGLRDSIANEATIKAGQNYTDASQNKQTDYNSAVTAAKAIIGQTTSPSMNAQEINQAKDQVTAKQQALNGQENLRTAQTNAKQHLNGLSDLTDAQKDAVKRQIEGATHVNEVTQAQNNADALNTAMTNLKNGIQDQNTIKQGVNFTDADEAKRNAYTNAVTQAEQILNKAQGPNTSKDGVETALENVQRAKNELNGNQNVANAKTTAKNALNNLTSINNAQKEALKSQIEGATTVAGVNQVSTTASELNTAMSNLQNGINDEAATKAALNGTQNLEKAKQHANTAIDGLSHLTNAQKEALKQLVQQSTTVAEAQGNEQKANNVDAAMDKLRQSIADNATTKQNQNYTDASQNKKDAYNNAVTTAQGIIDQTTSPTLDPTVINQAAGQVSTTKNALNGNENLEAAKQQASQSLGSLDNLNNAQKQTVTDQINGAHTVDEANQIKQNAQNLNTAMGNLKQAIADKDATKATVNFTDADQAKQQAYNTAVTNAENIISKANGGNATQAEVEQAIKQVNAAKQALNGNANVQHAKDEATALINSSNDLNQAQKDALKQQVQNATTVAGVNNVKQTAQELNNAMTQLKQGIADKEQTKADGNFVNADPDKQNAYNQAVAKAEALISATPDVVVTPSEITAALNKVTQAKNDLNGNTNLATAKQNVQHAIDQLPNLNQAQRDEYSKQITQATLVPNVNAIQQAATTLNDAMTQLKQGIANKAQIKGSENYHDADTDKQTAYDNAVTKAEELLKQTTNPTMDPNTIQQALTKVNDTNQALNGNQKLADAKQDAKTTLGTLDHLNDAQKQALTTQVEQAPDIATVNNVKQNAQNLNNAMTNLNNALQDKTETLNSINFTDADQAKKDAYTNAVSHAEGILSKANGSNASQTEVEQAMQRVNEAKQALNGNDNVQRAKDAAKQVITNANDLNQAMTQLKQGIADKDQTKANGNFVNADTDKQNAYNNAVAHAEQIISGTPNANVDPQQVAQALQQVNQAKGDLNGNHNLQVAKDNANTAIDQLPNLNQPQKTALKDQVSHAELVTGVNAIKQNADALNNAMGTLKQQIQANSQVPQSVDFTQADQDKQQAYNNAANQAQQIANGIPTPVLTPDTVTQAVTTMNQAKDALNGDEKLAQAKQEALANLDTLRDLNQPQRDALRNQINQAQALATVEQTKQNAQNVNTAMSNLKQGIANKDTVKASENYHDADADKQTAYTNAVSQAEGIINQTTNPTLNPDEITRALTQVTDAKNGLNGEAKLATEKQNAKDAVSGMTHLNDAQKQALKGQIDQSPEIATVNQVKQTATSLDQAMDQLSQAINDKAQTLADGNYLNADPDKQNAYKQAVAKAEALLNKQSGTNEVQAQVESITNEVNAAKQALNGNDNLANAKQQAKQQLANLTHLNDAQKQSFESQITQAPLVTDVTTINQKAQTLDHAMELLRNSVADNQTTLASEDYHDATAQRQNDYNQAVTAANNIINQTTSPTMNPDDVNGATTQVNNTKVALDGDENLAAAKQQANNRLDQLDHLNNAQKQQLQSQITQSSDIAAVNGHKQTAESLNTAMGNLINAIADHQAVEQRGNFINADTDKQTAYNTAVNEAAAMINKQTGQNANQTEVEQAITKVQTTLQALNGDHNLQVAKTNATQAIDALTSLNDPQKTALKDQVTAATLVTAVHQIEQNANTLNQAMHGLRQSIQDNAATKANSKYINEDQPEQQNYDQAVQAANNIINEQTATLDNNAINQAATTVNTTKAALHGDVKLQNDKDHAKQTVSQLAHLNNAQKHMEDTLIDSETTRTAVKQDLTEAQALDQLMDALQQSIADKDATRASSAYVNAEPNKKQSYDEAVQNAESIIAGLNNPTINKGNVSSATQAVISSKNALDGVERLAQDKQTAGNSLNHLDQLTPAQQQALENQINNATTRDKVAEIIAQAQALNEAMKALKESIKDQPQTEASSKFINEDQAQKDAYTQAVQHAKDLINKTTDPTLAKSIIDQATQAVTDAKNNLHGDQKLAQDKQRATETLNNLSNLNTPQRQALENQINNAATRGEVAQKLTEAQALNQAMEALRNSIQDQQQTEAGSKFINEDKPQKDAYQAAVQNAKDLINQTNNPTLDKAQVEQLTQAVNQAKDNLHGDQKLADDKQHAVTDLNQLNGLNNPQRQALESQINNAATRGEVAQKLAEAKALDQAMQALRNSIQDQQQTESGSKFINEDKPQKDAYQAAVQNAKDLINQTGNPTLDKSQVEQLTQAVTTAKDNLHGDQKLARDQQQAVTTVNALPNLNHAQQQALTDAINAAPTRTEVAQHVQTATELDHAMETLKNKVDQVNTDKAQPNYTEASTDKKEAVDQALQAAESITDPTNGSNANKDAVDQVLTKLQEKENELNGNERVAEAKTQAKQTIDQLTHLNADQIATAKQNIDQATKLQPIAELVDQATQLNQSMDQLQQAVNEHANVEQTVDYTQADSDKQNAYKQAIADAENVLKQNANKQQVDQALQNILNAKQALNGDERVALAKTNGKHDIDQLNALNNAQQDGFKGRIDQSNDLNQIQQIVDEAKALNRAMDQLSQEITDNEGRTKGSTNYVNADTQVKQVYDETVDKAKQALDKSTGQNLTAKQVIKLNDAVTAAKKALNGEERLNNRKAEALQRLDQLTHLNNAQRQLAIQQINNAETLNKASRAINRATKLDNAMGSVQQYIDEQHLGVISSTNYINADDNLKANYDNAIANAAHELDKVQGNAIAKAEAEQLKQNIIDAQNALNGDQNLANAKDKANAFVNSLNGLNQQQQDLAHKAINNADTVSDVTDIVNNQIDLNDAMETLKHLVDNEIPNAEQTVNYQNADDNAKTNFDDAKRLANTLLNSDNTNVNDINGAIQAVNDAIHNLNGDQRLQDAKDKAIQSINQALANKLKEIEASNATDQDKLIAKNKAEELANSIINNINKATSNQAVSQVQTAGNHAIEQVHANEIPKAKIDANKDVDKQVQALIDEIDRNPNLTDKEKQALKDRINQILQQGHNGINNAMTKEEIEQAKAQLAQALQDIKDLVKAKEDAKQDVDKQVQALIDEIDQNPNLTDKEKQALKDRINQILQQGHNDINNAMTKEAIEQAKERLAQALQDIKDLVKAKEDAKNDIDKRVQALIDEIDQNPNLTDKEKQALKDRINQILQQGHNDINNALTKEEIEQAKAQLAQALQDIKDLVKAKEDAKNAIKALANAKRDQINSNPDLTPEQKAKALKEIDEAEKRALQNVENAQTIDQLNRGLNLGLDDIRNTHVWEVDEQPAVNEIFEATPEQILVNGELIVHRDDIITEQDILAHINLIDQLSAEVIDTPSTATISDSLTAKVEVTLLDGSKVIVNVPVKVVEKELSVVKQQAIESIENAAQQKINEINNSVTLTLEQKEAAIAEVNKLKQQAIDHVNNAPDVHSVEEIQQQEQAHIEQFNPEQFTIEQAKSNAIKSIEDAIQHMIDEIKARTDLTDKEKQEAIAKLNQLKEQAIQAIQRAQSIDEISEQLEQFKAQMKAANPTAKELAKRKQEAISRIKDFSNEKINSIRNSEIGTADEKQAAMNQINEIVLETIRDINNAHTLQQVEAALNNGIARISAVQIVTSDRAKQSSSTGNESNSHLTIGYGTANHPFNSSTIGHKKKLDEDDDIDPLHMRHFSNNFGNVIKNAIGVVGISGLLASFWFFIAKRRRKEDEEEELEIRDNNKDSIKETLDDTKHLPLLFAKRRRKEDEEDVTVEEKDSLNNGESLDKVKHTPFFLPKRRRKEDEEDVEVTNENTDEKVLKDNEHSPLLFAKRRKDKEEDVETTTSIESKDEDVPLLLAKKKNQKDNQSKDKKSASKNTSKKVAAKKKKKKAKKNKK

SEQ ID NO: 4497 - DNA, 285 bp, Staphylococcus aureus
atggataaccacactgcagaatgggctgcatgtatttatgcactagaacatgcacgtgaattaaatgttcaaaacgcactattatatacagactcaaagctaattgcagatagcattgaagctggttatgtgaaaaacgcaaatttcaaaccttattttgatcaaatagaaatatttgaaaaagattttgatttattatttgttaaatggataccgagagaacaaaacaaagaagcgaatcaacacgctcaacaggcattgtataaattaattaaaaagaataaa

SEQ ID NO: 4498 - protein, 95 aa, Staphylococcus aureus
  MISC_FEATURE (1)..(95): hypothetical protein
MDNHTAEWAACIYALEHARELNVQNALLYTDSKLIADSIEAGYVKNANFKPYFDQIEIFEKDFDLLFVKWIPREQNKEANQHAQQALYKLIKKNK

SEQ ID NO: 4499 - DNA, 171 bp, Staphylococcus aureus
ttgattacaatggcacatgtacttatgcctggatttcctttcgtcgcagcatcaaaatttattttcgccataataaacctactttctattcaatacttagttaaagttactattactgtaatacaaaatatgttgggtaatccattaaaaaacacgcatcacttaaataag

SEQ ID NO: 4500 - protein, 57 aa, Staphylococcus aureus
LITMAHVLMPGFPFVAASKFIFAIINLLSIQYLVKVTITVIQNMLGNPLKNTHHLNK

SEQ ID NO: 4501 - DNA, 129 bp, Staphylococcus aureus
gtgggtcccaacacagaagatgacgaaaagtcagcttacaataatgtgcaagtttgggatgggccccaacaaagagaaattggattcccaatttctacagacaatgcaagttggggtgggacgacgaaa

SEQ ID NO: 4502 - protein, 43 aa, Staphylococcus aureus
VGPNTEDDEKSAYNNVQVWDGPQQREIGFPISTDNASWGGTTK

SEQ ID NO: 4503 - DNA, 702 bp, Staphylococcus aureus
atgtataatgaaattttaggactagttacgtttattgcaacgttcgtgcttatggtacttatgtatcgcttttttggtaaacaaggtttaattgcatgggttgcaattggcacaatcattgccaacatacaagtgattaaaactgtagaaatctttggtatttcagcaactttaggtaatgtcatgtttgcttctatttatttagcaacagatatattaaacgatatttatgggcgtagagttgcaaaaagagcagtttggttaggcttttcatcaacattaattatgattattgttatgcaattgtcattacattttattcctgcaccagaagatatggcacaaaaagcattacacgcaatctttgatgttgtgccacgcattgctttaggctcaatcgtcgcatatattattggtcaacatattgatgtatttatcttttcactaattaaaaaagtatttagttctgataaaacgtttttcatccgtgcatatggtagtacatttttaagctcaataattgatacagctttatttgtagctatcgcatttatcggaagtttacctggtacagttgtatttgaaatatttattacaacgtacgtattaaaattagcttcaacagttttcaatgtaccatttggatatattgctaaatcattttatcgtaaaggtaagattgataagttagatcaaggctat

SEQ ID NO: 4504 - protein, 234 aa, Staphylococcus aureus
  MISC_FEATURE (1)..(234): conserved hypothetical
MYNEILGLVTFIATFVLMVLMYRFFGKQGLIAWVAIGTIIANIQVIKTVEIFGISATLGNVMFASIYLATDILNDIYGRRVAKRAVWLGFSSTLIMIIVMQLSLHFIPAPEDMAQKALHAIFDVVPRIALGSIVAYIIGQHIDVFIFSLIKKVFSSDKTFFIRAYGSTFLSSIIDTALFVAIAFIGSLPGTVVFEIFITTYVLKLASTVFNVPFGYIAKSFYRKGKIDKLDQGY

SEQ ID NO: 4505 - DNA, 219 bp, Staphylococcus aureus
ttgcaatattttgaagtaataaaggaagtgtcgcgtattttaactttttcagagcaaaatgcactcgcgaaaatagatgatttaatgaatacttattgcaatcaatgtccaatcaaaactcgtctgcgtaaattagaggggaaaacgaaggcgcatcatttttgtatcaatgagtgttcaatagggaaagaaataaaacaattaggaaatgaacttcaa

SEQ ID NO: 4506 - protein, 73 aa, Staphylococcus aureus
  MISC_FEATURE (1)..(73): conserved hypothetical
LQYFEVIKEVSRILTFSEQNALAKIDDLMNTYCNQCPIKTRLRKLEGKTKAHHFCINECSIGKEIKQLGNELQ

SEQ ID NO: 4507 - DNA, 1128 bp, Staphylococcus aureus
atgaattggagcgatttgatggaacaaaggacgcgactagctttattaaaagagattgccgaatttttaaacgaagaaactgaaatgtatagcatgacccaaggtgcgttaaaatatttaattgagggcagtaatttcacgacaggctggatatttttcatcaatagcgtaggtgaacatgaacttgtatcacatgtggctctaccacaatctttgacagcagaccactgtcactatattaaagatgggtcttgttggtgtgtgaaagcatttaatcaacgtaggctaatgaaagcgtcgaatatcgtcaattgttctcgtattaacttagcctctaaagcatttcctagccaaaatgacaatattacacatcatgcaacggtaccacttaaatcgggtcaagaacaattcggcattttaaatgtagcgtctccaaatactgaaatatatagcgatgaagatttagagttgctagagtctgtcgcatttcaattagggtcagccatcaaacgtatttatttaacagaccgtgaaaaagaagcggcaaaaattaatgaacgtaatcgtttagctagagatttacatgattcagtaaatcaaatgttattttctgtaaaactaacagcacatgctgcgtatggcatgtcaaacgaatccatcgctaaacaagcattcaagacgattgaggaaacgagtcaaaatgccgttaatgaaatgcgtgcattgatttggcaacttaagccagttggacttgagcaaggtttaattcatgctttgacagcatatagtaaattaatgcatatacaattaaatgtaaatgtagaaggtttaatcgatttatctaatgaaatcgaagaaaacatatacagagcattacaagagtgtattaataatgttaagaaacatgctgatacgaataaaatggatcttacattaaaacaaatgaacgatatactatatattgacgtgattgattatggtcaaggatttgagatcgataatgttcagatagcttcatcacacggtattaataacataaaacaaagagttaaattattaagaggtaaagtgacctttcattctcagccaacaaagggtacacaaatacaattcacaattcctataaaa

SEQ ID NO: 4508 - protein, 376 aa, Staphylococcus aureus
  MISC_FEATURE (1)..(376): two-component sensor
MNWSDLMEQRTRLALLKEIAEFLNEETEMYSMTQGALKYLIEGSNFTTGWIFFINSVGEHELVSHVALPQSLTADHCHYIKDGSCWCVKAFNQRRLMKASNIVNCSRINLASKAFPSQNDNITHHATVPLKSGQEQFGILNVASPNTEIYSDEDLELLESVAFQLGSAIKRIYLTDREKEAAKINERNRLARDLHDSVNQMLFSVKLTAHAAYGMSNESIAKQAFKTIEETSQNAVNEMRALIWQLKPVGLEQGLIHALTAYSKLMHIQLNVNVEGLIDLSNEIEENIYRALQECINNVKKHADTNKMDLTLKQMNDILYIDVIDYGQGFEIDNVQIASSHGINNIKQRVKLLRGKVTFHSQPTKGTQIQFTIPIK

SEQ ID NO: 4509 - DNA, 819 bp, Staphylococcus aureus
atgaaatttaaaataccagaaaactttaatgacttaagtttacgagatattttccaacaacttaaggtacctaaaaaagatttacatcatttaaatatgtctaaagatattactattaatgataaacctgcgcgattaatggataaagtgcatactggcgacgatgtatttgttccaaccatcgatgaaaaaagtaattatgttccaagttatcgttatgcacaaattaaatacgaagacgatgatatggcaatcgtaatgaaacctaaaggtgttaagactcaccctaatgatttaaaagaaagcaatactttaatgaatcatgtgatttacactattgatagtgactatgtcgaaccaattcatcgactggaccaggaaacagtaggattattaattgttgctaaaaatcctttaatgaaaaaaattcttgatcgcatgttagaagacaatgatattacgcggatatacaaagcaaatgttaaggcacttttacctttaaaaccacaaacgattgatatgccaattggtaaagataaattccattcgaataaacgacgtgtgtctcctactggacagcgtgcaattacacacattttaacttcaaaaatgataaaagaagctgtgtgccaacttgaaatcaagttggatactggacgtactcatcaaattcgtgtgcatttagctgaaattggtcaccctgttattggtgatcctttatatggtgattcaacgttaagacaattagaacttgaaagttacaaaatagagtttgtgcatcccttgactaaggaagtcatttccgtttctttggatgac

SEQ ID NO: 4510 - protein, 273 aa, Staphylococcus aureus
  MISC_FEATURE (1)..(273): conserved hypothetical
MKFKIPENFNDLSLRDIFQQLKVPKKDLHHLNMSKDITINDKPARLMDKVHTGDDVFVPTIDEKSNYVPSYRYAQIKYEDDDMAIVMKPKGVKTHPNDLKESNTLMNHVIYTIDSDYVEPIHRLDQETVGLLIVAKNPLMKKILDRMLEDNDITRIYKANVKALLPLKPQTIDMPIGKDKFHSNKRRVSPTGQRAITHILTSKMIKEAVCQLEIKLDTGRTHQIRVHLAEIGHPVIGDPLYGDSTLRQLELESYKIEFVHPLTKEVISVSLDD

SEQ ID NO: 4511 - DNA, 249 bp, Staphylococcus aureus
atgaaaattatatctatatcagaaacaccgaaccacaacacaatgaagattacacttagtgaaagcagagaaggtatgacatcagatacgtatactaaagttgatgattcacagccagcatttattaatgacatcttaaaggttgaaggcgttaaatcaattttccatgttatggactttatttcagtagataaagaaaatgacgcaaattgggaaacagtattgccaaaagtagaggctgtattcgaa

SEQ ID NO: 4512 - protein, 83 aa, Staphylococcus aureus
  MISC_FEATURE (1)..(83): conserved hypothetical
MKIISISETPNHNTMKITLSESREGMTSDTYTKVDDSQPAFINDILKVEGVKSIFHVMDFISVDKENDANWETVLPKVEAVFE

SEQ ID NO: 4513 - DNA, 93 bp, Staphylococcus aureus
ttggaaaatggtttaacattcgtaatcgagtcttccaattatcagttgcatgatattcatccaaagagacatgtcgatagaaatgataattat

SEQ ID NO: 4514 - protein, 31 aa, Staphylococcus aureus
LENGLTFVIESSNYQLHDIHPKRHVDRNDNY

SEQ ID NO: 4515 - DNA, 1122 bp, Staphylococcus aureus
atggaaattttacgtatagagccaacaccaagtccaaatacaatgaaagttgttttgtcatatacaagagaagacaagttatctaatacttataaaaaagtagaagaaacacaaccaagatttataaatcagttgttatctatagatggtatcacttccatttttcatgtcatgaacttcttagctgttgataaggcaccaaaagctgattgggaagtcatattacctgatattaaagctgctttttctgatgcgaataaggttttagaatctgtaaatgaacctcaaattgacaatcattttggtgaaattaaagctgaattattaacttttaagggtataccgtatcaaattaagctaacttctgctgaccaagaattaagagaacaattaccacaaacatatgttgaccatatgactcaagcgcaaacagcacatgacaatattgtttttatgcgtaaatggctagatttaggaaatcgctatggaaatattcaagaagtaatggatggtgtcctagaagaagtgctagctacctatccagaatcacagttacccgtattggtaaaacatgctttagaagaaaatcacgcaactaataattatcatttctatcgacatgtctctttggatgaatatcatgcaactgataattggaagactcgattacgaatgttaaaccattttccaaagccgacttttgaagatataccgctgcttgatttagctttatctgatgaaaaagtaccggttagacgtcaagcgattgtattattaggtatgattgaaagtaaagaaattttaccgtatttatataaggggcttcgtgataaaagtcctgctgtaagaagaacagcaggggattgcataagcgatttagggtatccagaggcactaccagaaatggtgctactattagatgatccacagaaaatcgttaggtggcgtgctgctatgtttatctttgatgaaggtaatgcagagcagcttcccgcactaaaagcccatattaatgacaatgcgtttgaagttaaattacaaattgaaatggccatatctcgtattgaaaacggagatgaagcacttggttcagtatggaaacaaatggcaaacagaacaatt

SEQ ID NO: 4516 - protein, 374 aa, Staphylococcus aureus
  MISC_FEATURE (1)..(374): conserved hypothetical
MEILRIEPTPSPNTMKVVLSYTREDKLSNTYKKVEETQPRFINQLLSIDGITSIFHVMNFLAVDKAPKADWEVILPDIKAAFSDANKVLESVNEPQIDNHFGEIKAELLTFKGIPYQIKLTSADQELREQLPQTYVDHMTQAQTAHDNIVFMRKWLDLGNRYGNIQEVMDGVLEEVLATYPESQLPVLVKHALEENHATNNYHFYRHVSLDEYHATDNWKTRLRMLNHFPKPTFEDIPLLDLALSDEKVPVRRQAIVLLGMIESKEILPYLYKGLRDKSPAVRRTAGDCISDLGYPEALPEMVLLLDDPQKIVRWRAAMFIFDEGNAEQLPALKAHINDNAFEVKLQIEMAISRIENGDEALGSVWKQMANRTI

SEQ ID NO: 4517 - DNA, 450 bp, Staphylococcus aureus
ttggaggaattaaatatgaatgcatatgatgcttatatgaaagaaattgcgcaacaaatgcgtggcgaattaactcaaaatggttttacaagtttagaaacgagcgaagcagtatcggagtatatgaaccaagtaaatgctgatgacactacttttgtagttattaactctacatgcggctgtgcagctggattagcaagaccagctgcagtagcagttgcaacacaaaatgaacatagacctacaaatacagttacagtttttgctgggcaagataaagaagcaactgctacaatgcgagaattcattcagcaagcaccatctagtccttcgtatgctttattcaaaggtcaagatttagtttattttatgcctagagaatttatcgaaggtagagatattaatgacattgcaatggacttaaaggatgcctttgacgaaaattgtaaa

SEQ ID NO: 4518 - protein, 150 aa, Staphylococcus aureus
  MISC_FEATURE (1)..(150): conserved hypothetical
LEELNMNAYDAYMKEIAQQMRGELTQNGFTSLETSEAVSEYMNQVNADDTTFVVINSTCGCAAGLARPAAVAVATQNEHRPTNTVTVFAGQDKEATATMREFIQQAPSSPSYALFKGQDLVYFMPREFIEGRDINDIAMDLKDAFDENCK

SEQ ID NO: 4519 - DNA, 966 bp, Staphylococcus aureus
gtgttatcgcatatgttgaattcatttgatgcagcatatcacagtctttgtgaagaagttttagaaataggaaatacacgaaatgatcgcacaaatacaggtacgatttcgaaatttggtcatcaacttcgctttgacttatctaaaggatttccactattaacgacaaagaaagtttcttttaaattagtagcaaccgaattattatggttcattaaaggagatacaaacatccaatacttattaaaatataataataatatatggaacgaatgggcttttgaaaattatatcaaatcagacgagtataaaggtccagatatgacagatttcgggcatcgtgcattgagtgatcctgaatttaacgaacaatataaagaacaaatgaaacaatttaagcaacgtattcttgaagatgatacatttgcgaagcaattcggggatttaggaaatgtttatggtaaacaatggcgagattgggttgataaagatggtaatcattttgatcaacttaaaacagtaattgaacaaattaagcataatccagattcaaggcgacacatcgtatctgcatggaatccaacagaaattgatacaatggcacttccgccttgtcataccatgttccagttttatgtccaagatggtaagttaagttgccagttataccaacgtagcgcagatatctttttaggtgtgccatttaatatcgcaagctacgctttattgacacaccttattgccaaagaatgtggacttgaagtgggtgaatttgtgcatacatttggagatgcacatatttattcaaatcatattgatgcgattcaaacacaattagcacgtgaaagcttcaatcctccaacattaaaaattaacagtgacaagtctattttcgacataaattatgaagatttggaaattgttgactatgaatcacatccagcaataaaagctccaatagcagtg

SEQ ID NO: 4520 - protein, 322 aa, Staphylococcus aureus
  MISC_FEATURE (1)..(322): thymidylate synthase
VLSHMLNSFDAAYHSLCEEVLEIGNTRNDRTNTGTISKFGHQLRFDLSKGFPLLTTKKVSFKLVATELLWFIKGDTNIQYLLKYNNNIWNEWAFENYIKSDEYKGPDMTDFGHRALSDPEFNEQYKEQMKQFKQRILEDDTFAKQFGDLGNVYGKQWRDWVDKDGNHFDQLKTVIEQIKHNPDSRRHIVSAWNPTEIDTMALPPCHTMFQFYVQDGKLSCQLYQRSADIFLGVPFNIASYALLTHLIAKECGLEVGEFVHTFGDAHIYSNHIDAIQTQLARESFNPPTLKINSDKSIFDINYEDLEIVDYESHPAIKAPIAV

SEQ ID NO: 4521 - DNA, 477 bp, Staphylococcus aureus
atgactttatccattctagttgcacatgacttgcaacgagtaattggttttgaaaatcaattaccttggcacctaccaaatgatttgaagcatgttaaaaaattatcaacaggtcatactttagtaatgggtcgtaagacatttgaatcgattggtaaaccactaccgaatcgtcgaaatgttgtacttacttcagatacaagtttcaacgtagagggcgttgatgtaattcactctattgaagatatttaccaactaccgggccatgttttcatatttggagggcaaacattatttgaagaaatgattgataaagtggacgacatgtatattactgttattgaaggtaaattccgtggtgatacgttctttccaccttatacatttgaagactgggaagttgcctcttcagttgaaggtaaactagatgagaaaaatacaattccacatacctttctacatttaattcgtaaaaaa

SEQ ID NO: 4522 - protein, 159 aa, Staphylococcus aureus
  MISC_FEATURE (1)..(159): dihydrofolate reductase
MTLSILVAHDLQRVIGFENQLPWHLPNDLKHVKKLSTGHTLVMGRKTFESIGKPLPNRRNVVLTSDTSFNVEGVDVIHSIEDIYQLPGHVFIFGGQTLFEEMIDKVDDMYITVIEGKFRGDTFFPPYTFEDWEVASSVEGKLDEKNTIPHTFLHLIRKK

SEQ ID NO: 4523 - DNA, 837 bp, Staphylococcus aureus
atgacaaaacagattatagtaacagactcaacatccgatttatctaaagaatacttagaagcaaacaacattcatgtaattcctttaagtttaactattgaaggagcttcatacgttgaccaagtagatattacatcagaagaatttattaatcatattgaaaatgatgaagatgtaaagacaagtcagccagccataggtgaatttatatctgcttatgaagaactaggaaaagatggctctgaaatcataagtattcatctttcttcaggattaagtggtacatataacactgcttaccaagcaagtcaaatggtagatgctaatgtaactgttattgattcaaaatctatttcttttggtttagggtatcaaatacaacacctagtagagcttgtaaaagaaggtgtctcaacttctgaaatagttaaaaagttaaatcatttaagagaaaacattaaattatttgtagttatagggcaattgaatcaattaattaaaggtggcagaattagtaaaacaaaaggtttgattggtaatcttatgaaaattaaaccaattggtacactagatgatggtcgcttagagcttgtgcacaatgcgagaactcaaaattctagtatccaatacttgaaaaaggaaattgctgaatttataggagatcatgaaatcaaatccattggtgtcgcacatgctaacgtcattgaatatgttgataaattgaagaaagtttttaatgaagcttttcatgtgaataattacgatataaatgtaactacaccagttatttctgcacatactggtcaaggtgcgattggcctcgtagtccttaagaag

SEQ ID NO: 4524 - protein, 279 aa, Staphylococcus aureus
  MISC_FEATURE (1)..(279): conserved hypothetical
MTKQIIVTDSTSDLSKEYLEANNIHVIPLSLTIEGASYVDQVDITSEEFINHIENDEDVKTSQPAIGEFISAYEELGKDGSEIISIHLSSGLSGTYNTAYQASQMVDANVTVIDSKSISFGLGYQIQHLVELVKEGVSTSEIVKKLNHLRENIKLFVVIGQLNQLIKGGRISKTKGLIGNLMKIKPIGTLDDGRLELVHNARTQNSSIQYLKKEIAEFIGDHEIKSIGVAHANVIEYVDKLKKVFNEAFHVNNYDINVTTPVISAHTGQGAIGLVVLKK

SEQ ID NO: 4525 - DNA, 531 bp, Staphylococcus aureus
atgacaaaagaatatgcaacattagcaggaggatgtttctggtgcatggttaaaccatttacatcatatccaggcatcaagtcagtcgtatctggttatagtggcggtcatgttgacaacccaacttatgaacaggtatgtacgaatcaaaccggccatgtcgaagcagtacaaattacgtttgatccagaggttacttcctttgaaaatatattagacatatatttcaaaacatttgacccaactgatgatcaagggcaatttttcgatagaggcgaaagctatcaaccagtcattttctatcatgatgaacatcagaaaaaggctgctgagtttaaaaagcaacaattaaatgaacaaggtattttcaagaaaccagtgattacacctattaaaccatataaaaatttctatccagctgaagactaccatcaagattattacaaaaagaacccggtacattattaccaatatcaacgtggttcaggtagaaaagcgtttatagaatcacattgggggaatcaaaatgct

SEQ ID NO: 4526 - protein, 177 aa, Staphylococcus aureus
  MISC_FEATURE (1)..(177): peptide methionine
MTKEYATLAGGCFWCMVKPFTSYPGIKSVVSGYSGGHVDNPTYEQVCTNQTGHVEAVQITFDPEVTSFENILDIYFKTFDPTDDQGQFFDRGESYQPVIFYHDEHQKKAAEFKKQQLNEQGIFKKPVITPIKPYKNFYPAEDYHQDYYKKNPVHYYQYQRGSGRKAFIESHWGNQNA

SEQ ID NO: 4527 - DNA, 426 bp, Staphylococcus aureus
atgcttaaaaaagataaaagtgaactaacagatatagaatatattgttacacaagaaaacggcactgaaccaccatttatgaatgaatattggaatcattttgctaaaggaatttatgtagataaaatttctggtaaacctttatttacatctgaagaaaagtttcattctgaatgtggatggcctagcttttccaaagcgcttgatgacgatgaaattatagaattagtcgacaaatcatttggtatgttgagaactgaagtgcgttcagaagaatcaaatagtcatttaggacatgtctttaatgatggacctaaagaaagtggcggcttaagatactgtatcaattccgctgcaattcaatttattccatatgaaaagttagaagaattgggttatggcgatttaatatcacattttgataag

SEQ ID NO: 4528 - protein, 142 aa, Staphylococcus aureus
  MISC_FEATURE (1)..(142): conserved hypothetical
MLKKDKSELTDIEYIVTQENGTEPPFMNEYWNHFAKGIYVDKISGKPLFTSEEKFHSECGWPSFSKALDDDEIIELVDKSFGMLRTEVRSEESNSHLGHVFNDGPKESGGLRYCINSAAIQFIPYEKLEELGYGDLISHFDK

SEQ ID NO: 4529 - DNA, 507 bp, Staphylococcus aureus
gtggaaagtatgtttaaaaaattattcggaaaaggcaaagaagttcagaaagatatcgcaatttatgcaccattaactggagaattcgtgaaaattgaagatattccagatcctgtattcgcacaaaaaatgatgggcgaaggttttggtattaatccaactgaaggagaagttgtgtctccaattgcaggacgtgttgacaatgtctttccaactaagcatgcgattgggttaaaagcagataacggattagaattattagttcatatcggtttagacacagttcaattagacggtgaaggatttgaagtgttagtgtctagtggtgacgaagttaacgtcggagatccattagtaagattcaaccttgaatatattaataataacgctaaatctgtaatttcaccaattataattactaacactgatcaagcagcttcaattaatatttatgatgaaaatgctgtgattaaaggtgaaacaaaagtgattgatgtgacaatgaac

SEQ ID NO: 4530 - protein, 169 aa, Staphylococcus aureus
  MISC_FEATURE (1)..(169): glucose-specific enzyme II,
VESMFKKLFGKGKEVQKDIAIYAPLTGEFVKIEDIPDPVFAQKMMGEGFGINPTEGEVVSPIAGRVDNVFPTKHAIGLKADNGLELLVHIGLDTVQLDGEGFEVLVSSGDEVNVGDPLVRFNLEYINNNAKSVISPIIITNTDQAASINIYDENAVIKGETKVIDVTMN

SEQ ID NO: 4531 - DNA, 219 bp, Staphylococcus aureus
atgaaaaactattcgttttatcaatttgtcatgacagttcgtggtcgacacgacgataaaggtcgtctagcagaagagatatttgacgatcttgctttcccaaaacacgatgatgattttaacatactgtctgattatattgagacacatggtgatttcacattgccaatgtctgtatttgatgatttatatgaagaatatacggaatggctaaaattt

SEQ ID NO: 4532 - protein, 73 aa, Staphylococcus aureus
  MISC_FEATURE (1)..(73): conserved hypothetical
MKNYSFYQFVMTVRGRHDDKGRLAEEIFDDLAFPKHDDDFNILSDYIETHGDFTLPMSVFDDLYEEYTEWLKF

SEQ ID NO: 4533 - DNA, 1488 bp, Staphylococcus aureus
atggatgataagcaacacacatcttcatccgatgatgaacgcgctgaaattgcaacaagcaatcaagaccaagaaactaattcatcgaaacgcgttcacttaaaacgttggcaattcatatcaatattaattggtacaatcctaataacagctgtcatcacagttgttgcatatatttttataaatcaaaaaataagtggtttaaacaaaactgatcaagcaaacttaaataaaattgaaaatgtgtataaaatcttaaatagtgattattacaaaaaacaggactctgacaagttaagtaaagctgcaattgatggcatggtcaaagaattaaaagatccttattctgaatatttaacaaaagaacaaacgaaatcctttaatgaaggtgtttcaggtgattttgtaggtattggtgcagaaatgcaaaagaaaaatgatcaaattatggttactagtcctatgaagggatctccagcagaacgtgctggcattcgtcctaaagatgtcattactaaagtaaatggaaaatcaattaaaggtaaagcattagatgaagttgtcaaagatgttcgtggtaaagaaaacactgaagtcactttaactgttcaacgaggtagtgaagaaaaagacgttaagattaaacgtgaaaaaattcatgttaaaagtgttgagtataagaaaaaaggtaaagttggagttattactattaataaattccagaatgatacatcaggtgaattgaaagatgcagttctaaaagctcacaaagatggtttgaaaaagattgttttagatttaagaaataatccaggtggactactagatgaagctgttaaaatggcaaatatttttatcgataaaggaaaaactgttgttaaactagaaaaaggtaaagatactgaagcaattcaaacttctaatgatgcgttaaaagaagcgaaagacatggatatatccatcttagtgaatgaaggttcagctagcgcttctgaagtgtttactggtgcgctaaaagactataataaagctaaagtttatgggtcaaaaacattcggcaaaggtgtcgtacaaactacaagagagtttaaggatggttcattgttaaaatatactgaaatgaaatggttaacgccagatggtcattatattcacggtaaaggcattaaaccagacgttactattgacacacctaaatatcaatctttaaatgtcattcctaatacgaaaacatttaaagttggagacgatgataaaaatattaaaactattaaaattggtttatcagctttaggttataaagttgataatgaatcaacgcaatttgataaagctttagaaaatcaagttaaagctttccaacaagcgaataaacttgaggtaactggtgaatttaataaagaaacgaataataaatttactgagttattagttgaaaaagctaataaacatgatgatgttctcgataagttgattaatattttaaaa

SEQ ID NO: 4534 - protein, 496 aa, Staphylococcus aureus
  MISC_FEATURE (1)..(496): probable carboxy-terminal
MDDKQHTSSSDDERAEIATSNQDQETNSSKRVHLKRWQFISILIGTILITAVITVVAYIFINQKISGLNKTDQANLNKIENVYKILNSDYYKKQDSDKLSKAAIDGMVKELKDPYSEYLTKEQTKSFNEGVSGDFVGIGAEMQKKNDQIMVTSPMKGSPAERAGIRPKDVITKVNGKSIKGKALDEVVKDVRGKENTEVTLTVQRGSEEKDVKIKREKIHVKSVEYKKKGKVGVITINKFQNDTSGELKDAVLKAHKDGLKKIVLDLRNNPGGLLDEAVKMANIFIDKGKTVVKLEKGKDTEAIQTSNDALKEAKDMDISILVNEGSASASEVFTGALKDYNKAKVYGSKTFGKGVVQTTREFKDGSLLKYTEMKWLTPDGHYIHGKGIKPDVTIDTPKYQSLNVIPNTKTFKVGDDDKNIKTIKIGLSALGYKVDNESTQFDKALENQVKAFQQANKLEVTGEFNKETNNKFTELLVEKANKHDDVLDKLINILK

SEQ ID NO: 4535 - DNA, 516 bp, Staphylococcus aureus
gtgacgtacatgatccgtctaggtaaaatgtcagatttagatcaaatcttaaatctagtagaagaagcaaaagaattaatgaaagaacacgacaacgagcaatgggacgatcagtacccacttttagaacattttgaagaagatattgctaaagattatttgtacgtattagaggaaaatgacaaaatttatggctttattgttgtcgaccaagaccaagcagaatggtatgatgacattgactggccagtaaatagagaaggcgcctttgttattcatcgattaactggttcgaaagaatataaaggagctgctacagaattattcaattatgttattgatgtagttaaagcacgtggtgcagaagttattttaacggacacctttgcgttaaacaaacctgcacaaggtttatttgccaaatttggatttcataaggtcggtgaacaattaatggaatatccgccatatgataaaggtgaaccattttatgcatattataaaaatttaaaagaa

SEQ ID NO: 4536 - protein, 172 aa, Staphylococcus aureus
  MISC_FEATURE (1)..(172): conserved hypothetical
VTYMIRLGKMSDLDQILNLVEEAKELMKEHDNEQWDDQYPLLEHFEEDIAKDYLYVLEENDKIYGFIVVDQDQAEWYDDIDWPVNREGAFVIHRLTGSKEYKGAATELFNYVIDVVKARGAEVILTDTFALNKPAQGLFAKFGFHKVGEQLMEYPPYDKGEPFYAYYKNLKE

SEQ ID NO: 4537 - DNA, 1068 bp, Staphylococcus aureus
atgacgaaaatcgcatttaccggagggggaacagttggacacgtatcagtaaatttaagtttaattccaactgcattatcacaaggttatgaagcgctttatattggttctaaaaatggtattgaaagagaaatgattgaatcacaactaccagaaattaagtattatcctatttcgagtggtaaattaagaagatatatttctttagaaaatgccaaagacgtatttaaagtattgaaaggtattcttgatgctcgtaaagttttgaaaaaagaaaaacctgatctattattttcaaaaggtggatttgtatctgtgcctgttgttattgcagccaaatcattaaatataccaactattattcatgaatctgacttaacaccaggattagcgaataagatagcacttaaatttgccaagaaaatatatacaacatttgaagaaacgctaaactacttacctaaagagaaagctgattttattggagcaacaattcgagaagatttaaaaaatggtaatgcacataatggttatcaattaacaggctttaatgaaaataaaaaagttttactcgttatgggtggaagcttaggaagtaaaaaattaaatagcattattcgcgaaaacttagatgcattattacaacaatatcaagtgatacatttaactggtaaaggattaaaagatgctcaagttaaaaaatcaggatatatacaatatgaatttgttaaagaggatttaacagatttattagcaattacggatacagtaataagtagagctggatcaaatgcgatttatgagttcttaacattacgtataccaatgttattagtaccattaggtttagatcaatcccgaggcgaccaaattgacaatgcaaatcattttgctgataaaggatatgctaaagcgattgatgaagaacaattaacagcacaaattttattacaagaactaaatgaaatggaacaggaaagaactcgaattatcaataatatgaaatcgtatgaacaaagttatacgaaagaagctttatttgataagatgattaaagacgcattgaat

SEQ ID NO: 4538 - protein, 356 aa, Staphylococcus aureus
MTKIAFTGGGTVGHVSVNLSLIPTALSQGYEALYIGSKNGIEREMIESQLPEIKYYPISSGKLRRYISLENAKDVFKVLKGILDARKVLKKEKPDLLFSKGGFVSVPVVIAAKSLNIPTIIHESDLTPGLANKIALKFAKKIYTTFEETLNYLPKEKADFIGATIREDLKNGNAHNGYQLTGFNENKKVLLVMGGSLGSKKLNSIIRENLDALLQQYQVIHLTGKGLKDAQVKKSGYIQYEFVKEDLTDLLAITDTVISRAGSNAIYEFLTLRIPMLLVPLGLDQSRGDQIDNANHFADKGYAKAIDEEQLTAQILLQELNEMEQERTRIINNMKSYEQSYTKEALFDKMIKDALN

SEQ ID NO: 4539 - DNA, 612 bp, Staphylococcus aureus
atgagtcaatggaaacgtatctctttgctcatcgtttttacattggtttttggaattatcgcgtttttccacgaatcaagacttgggaaatggattgataatgaagtttatgagtttgtatattcatcagagagctttattacgacatctatcatgcttggggctactaaagtaggtgaagtctgggcaatgttatgtatttcattacttcttgtggcatatctcatgttaaagcgccacaaaattgaagcattattttttgcattaacaatggcattatctggaattttgaatccagcattaaaaaatatattcgatagagaaagacctacattgctgcgtttaattgatataacaggatttagttttcctagcggtcatgctatgggatcaactgcatattttggaagtggtatctatctattaaatcgattaaatcaaggtaattcaaaaggtattcttatagggttatgtgcagctatgattttattgatttccatatcacgtgtatatctaggtgtacattatccaacagatattattgccggcattattggtggattattttgcattattttatcaacgttattacttagaaataaattaataaat

SEQ ID NO: 4540 - protein, 204 aa, Staphylococcus aureus
  MISC_FEATURE (1)..(204): conserved hypothetical
MSQWKRISLLIVFTLVFGIIAFFHESRLGKWIDNEVYEFVYSSESFITTSIMLGATKVGEVWAMLCISLLLVAYLMLKRHKIEALFFALTMALSGILNPALKNIFDRERPTLLRLIDITGFSFPSGHAMGSTAYFGSGIYLLNRLNQGNSKGILIGLCAAMILLISISRVYLGVHYPTDIIAGIIGGLFCIILSTLLLRNKLIN

SEQ ID NO: 4541 - DNA, 657 bp, Staphylococcus aureus
atgacgcaaattttaatagtagaagatgaacaaaacttagcaagatttcttgaattggaactcacacatgaaaattacaatgtggacacagagtatgatggacaagacggtttagataaagcgcttagccattactatgatttaatcatattagatttaatgttgccgtcaattaatggcttagaaatttgtcgcaaaattagacaacaacaatctacacctatcattataattacagcgaaaagtgatacgtatgacaaagttgctgggcttgattacggtgcagacgattatatagttaagccgtttgatattgaagaacttttagcaagaattcgtgcaattttacgtcgtcagccacaaaaggatattatcgatgtcaacggtattacaattgataagaacgcttttaaagtgacggtaaatggcgcagaaattgaattaacaaaaacagagtatgatttactatatcttctagctgaaaataaaaaccatgttatgcaacgggaacaaattttaaatcatgtatggggttataatagtgaagtagaaacaaatgtcgtagatgtttatataagatatttacgaaacaagttaaaaccatacgatcgtgacaaaatgattgaaacagttcgtggcgttgggtatgtgatacga

SEQ ID NO: 4542 - protein, 219 aa, Staphylococcus aureus
  MISC_FEATURE (1)..(219): truncated (putative
MTQILIVEDEQNLARFLELELTHENYNVDTEYDGQDGLDKALSHYYDLIILDLMLPSINGLEICRKIRQQQSTPIIIITAKSDTYDKVAGLDYGADDYIVKPFDIEELLARIRAILRRQPQKDIIDVNGITIDKNAFKVTVNGAEIELTKTEYDLLYLLAENKNHVMQREQILNHVWGYNSEVETNVVDVYIRYLRNKLKPYDRDKMIETVRGVGYVIR

SEQ ID NO: 4543 - DNA, 1353 bp, Staphylococcus aureus
atgacaaaacgtaaattgcgcaataactggattattgttaccacgatgattacgtttgtcacgatatttttgttttgtttaattattatttttttcttgaaagatacactgcataatagtgagcttgatgatgcagaacgaagctcaagcgatattaataatttatttcattctaagcctgttaaagatatatctgcattagacttgaatgcatctttaggtaattttcaagagataattatttatgatgagcataataataaattatttgagacatcgaatgataacacagtgagagttgaaccaggttatgaacaccgttattttgaccgcgtaataaaaaaacgctataaaggcattgaatatttaattattaaagaaccaattacaacgcaagatttcaaagggtatagcttgttaattcattcactagaaaattatgataacatcgtaaaatcattgtatatcattgcgctggcatttggagtgattgcaacaattataactgccacaatcagttatgtattttcaacacaaattactaaaccgcttgtcagtttatcaaataaaatgattgagattcgacgagatggttttcaaaataaattgcaattaaatacaaattatgaagaaatagataatttagcaaatacgtttaatgagatgatgagccaaattgaagaatcatttaatcaacaaagacaatttgttgaagatgcgtcacatgaattacgaacaccattacaaattattcaaggtcatttaaatttgattcagcgatggggaaaaaaagacccagcagtattagaagaatcgttaaatatttctattgaagaaatgaatcgtatcataaaattagtcgaagaattacttgaattgactaaaggagatgtaaatgacatttcttctgaagcacagaccgtgcatattaatgatgaaattcgctcgcgaatacactcattaaaacaattgcatcctgattatcaatttgatacggatctgacatctaaaaatctagaaattaaaatgaaacctcatcaattcgaacaattatttttaatctttattgataatgcaatcaaatatgatgtgaagaataagaaaattaaagttaagacaaggttaaaaaataagcaaaaaataattgaaattacagatcatggaattggtattccagaggaagatcaagatttcatttttgatcgcttttatcgagtggataaatctcgttcaagaagtcaaggcggtaatggactcggattatctattgctcaaaaaatcattcaattaaacggaggatcgattaaaattaaaagtgaaattaacaaaggaacaacgtttaaaatcatattt

SEQ ID NO: 4544 - protein, 451 aa, Staphylococcus aureus
  MISC_FEATURE (1)..(451): putative protein histidine
MTKRKLRNNWIIVTTMITFVTIFLFCLIIIFFLKDTLHNSELDDAERSSSDINNLFHSKPVKDISALDLNASLGNFQEIIIYDEHNNKLFETSNDNTVRVEPGYEHRYFDRVIKKRYKGIEYLIIKEPITTQDFKGYSLLIHSLENYDNIVKSLYIIALAFGVIATIITATISYVFSTQITKPLVSLSNKMIEIRRDGFQNKLQLNTNYEEIDNLANTFNEMMSQIEESFNQQRQFVEDASHELRTPLQIIQGHLNLIQRWGKKDPAVLEESLNISIEEMNRIIKLVEELLELTKGDVNDISSEAQTVHINDEIRSRIHSLKQLHPDYQFDTDLTSKNLEIKMKPHQFEQLFLIFIDNAIKYDVKNKKIKVKTRLKNKQKIIEITDHGIGIPEEDQDFIFDRFYRVDKSRSRSQGGNGLGLSIAQKIIQLNGGSIKIKSEINKGTTFKIIF

SEQ ID NO: 4545 - DNA, 2796 bp, Staphylococcus aureus
atgactaacgaaagaaaagaagtttcagaggctcctgtaaacttcggtgcgaatttaggtctaatgttagatctatatgatgactttttacaagatccatcatctgtaccagaagatttacaagtcttattcagcacaattaagaatgatgactcaattgtaccagctttaaaaagtacaagtagtcaaaatagcgacggcacaattaagcgtgtcatgcgtttaattgataatattcgccaatacgggcatcttaaagccgatatttatcctgtaaatcctccaaaaaggaaacatgtacctaaattagagattgaagactttgatttagatcaacagactttggaaggtatatcagcaggaattgtttcagatcactttgccgacatttatgataatgcttatgaagcaattttaagaatggaaaaacgttacaaaggaccaattgcatttgagtatacacatattaataacaataccgaacgtggttggttaaaaagaagaattgaaacgccatataaagtaacgttaaataataacgaaaaaagggcactattcaaacaattagcgtatgttgaagggtttgaaaaatatcttcataaaaacttcgttggtgcaaagcgtttttcaattgaaggggtagacgcacttgtaccgatgttacaacgtactattacgattgctgcgaaagaaggtattaaaaatatacaaataggcatggctcaccgtggacgtttaaacgttttaacgcatgtcttagaaaaaccgtacgaaatgatgatttcagaatttatgcatacagatccaatgaaattcttacctgaagatggtagcttgcagttaactgctggatggactggtgatgtgaaatatcaccttggtggcattaaaactactgattcatacggtacaatgcagcgtattgcactggctaacaatccaagtcacttggaaattgttgcacctgttgttgaggggcgtacgagagcagcacaagatgatacacaacgagctggggctccgacgactgatcatcataaagcaatgccaattattatacatggcgatgctgcttatcctggtcaaggaattaacttcgaaacaatgaacttaggaaacttgaaaggctattctacgggtggttcattgcatattattactaacaatagaattggatttactacagaaccaattgatgcacgttcaacaacttattctacagatgtggccaaaggttatgatgtgccaatattccatgtcaatgcagatgacgttgaagctactattgaagcaattgatattgcaatggaatttagaaaagagtttcataaagacgtcgttattgatttagtaggttatcgtcgtttcggacataacgaaatggatgaaccatcaattactaatccagttccttatcagaatattcgcaaacatgactctgttgaatatgtgtttggtaaaaagcttgttaatgaaggtgtcatttcagaagatgaaatgcattcatttatagaacaagtccaaaaggaactaagacaagctcatgataaaattaataaagctgataaaatggataatccagatatggaaaagcctgcagatcttgcattaccgttacaagcagacgaacaatcatttacttttgatcacttgaaagaaataaatgatgcattgttaacatatccggatggctttaacattttgaaaaagttaaacaaagttcttgagaagcgtcatgagccgtttaataaagaagatggtttagttgattgggcacaagcagaacaacttgcatttgcgacaattttacaagatggtacaccgattcgcttaactggtcaagatagtgaacgtggtacattcagtcataggcatgccgtgttacatgatgagcaaacaggtgaaacatatacacctttacatcatgttcctgatcaaaaagcgacatttgatatacacaattctccgctttcagaagcagcagtagttggttttgaatacggctataatgtggaaaacaaaaaaagcttcaatatttgggaagcacaatatggtgattttgcaaatatgtcacaaatgatttttgacaacttcttattcagttctcgctcaaaatggggagaacgttcaggattaacattattcttacctcatgcatatgagggtcaagggcctgaacattcatcagcaagattagagcgatttttacaattagctgctgaaaataattgcacagttgtcaacttatctagttcaagtaattatttccacttattgcgtgcacaagcggctagtttagattctgaacaaatgcgaccattggttgttatgtcaccaaaaagcttactgagaaataaaacagttgcaaaaccaattgatgaatttacttctggtggatttgagccaattttgacagaatcatatcaagcggataaggttacaaaagttattttggcaactggtaaaatgttcattgatttaaaagaagcattagctaaaaatccagacgaatcagtattactcgttgcgattgaaagattgtatccattcccagaggaagagattgaagcattactagcacaattgccaaaccttgaagaagtgtcatgggtacaagaagaacctaaaaatcaaggtgcatggttatatgtctatccatatgttaaagtgctagttgcagataaatatgatttaagttatcatggcagaattcaaagggctgctccagctgaaggcgatggagaaattcataaacttgttcaaaataaaattatagaaaatgcattaaaaaataac

SEQ ID NO: 4546 - protein, 932 aa, Staphylococcus aureus
  MISC_FEATURE (1)..(932): oxoglutarate dehydrogenase
MTNERKEVSEAPVNFGANLGLMLDLYDDFLQDPSSVPEDLQVLFSTIKNDDSIVPALKSTSSQNSDGTIKRVMRLIDNIRQYGHLKADIYPVNPPKRKHVPKLEIEDFDLDQQTLEGISAGIVSDHFADIYDNAYEAILRMEKRYKGPIAFEYTHINNNTERGWLKRRIETPYKVTLNNNEKRALFKQLAYVEGFEKYLHKNFVGAKRFSIEGVDALVPMLQRTITIAAKEGIKNIQIGMAHRGRLNVLTHVLEKPYEMMISEFMHTDPMKFLPEDGSLQLTAGWTGDVKYHLGGIKTTDSYGTMQRIALANNPSHLEIVAPVVEGRTRAAQDDTQRAGAPTTDHHKAMPIIIHGDAAYPGQGINFETMNLGNLKGYSTGGSLHIITNNRIGFTTEPIDARSTTYSTDVAKGYDVPIFHVNADDVEATIEAIDIAMEFRKEFHKDVVIDLVGYRRFGHNEMDEPSITNPVPYQNIRKHDSVEYVFGKKLVNEGVISEDEMHSFIEQVQKELRQAHDKINKADKMDNPDMEKPADLALPLQADEQSFTFDHLKEINDALLTYPDGFNILKKLNKVLEKRHEPFNKEDGLVDWAQAEQLAFATILQDGTPIRLTGQDSERGTFSHRHAVLHDEQTGETYTPLHHVPDQKATFDIHNSPLSEAAVVGFEYGYNVENKKSFNIWEAQYGDFANMSQMIFDNFLFSSRSKWGERSGLTLFLPHAYEGQGPEHSSARLERFLQLAAENNCTVVNLSSSSNYFHLLRAQAASLDSEQMRPLVVMSPKSLLRNKTVAKPIDEFTSGGFEPILTESYQADKVTKVILATGKMFIDLKEALAKNPDESVLLVAIERLYPFPEEEIEALLAQLPNLEEVSWVQEEPKNQGAWLYVYPYVKVLVADKYDLSYHGRIQRAAPAEGDGEIHKLVQNKIIENALKNN

SEQ ID NO: 4547 - DNA, 1266 bp, Staphylococcus aureus
atgccagaggttaaagttccagaattagcagaatctattacagaaggtaccattgcagaatggttgaaaaacgtaggggatagcgtagaaaaaggtgaagctattcttgaattagaaactgataaagttaatgtcgaagttgtatctgaagaagcaggtgtattatctgaacaacttgcaagtgaaggcgacactgtagaagttggacaagcaattgctatcatcggcgaaggtagtggcaatgcttctaaagaaaatagtaacgacaatactccacaacaaaatgaagaaacaaataataaaaaagaagaaacaacaaataattcggtagataaagctgaagtaaatcaagcaaatgatgacaatcagcaacgtattaatgctacgccttctgcgcgtcgatatgctcgtgaaaatggtgtgaatcttgctgaagtaagtccgaaaacaaatgatgtggttcgtaaagaagatattgataagaaacaacaggcaccggcatcaacacaaacaacacaacaagcatctgcaaaagaagagaaaaaatacaatcaatatcctacaaaaccagtgattcgtgaaaaaatgtcacgtagaaagaaaacagctgccaaaaaattattagaggtatctaataatacagctatgttaacaacatttaacgaagttgacatgacaaatgttatggaattgcgtaaacgtaagaaagaacaatttatgaaagatcatgatggtactaaattaggatttatgtcattctttactaaagcttctgtagcagctttgaaaaagtatccagaagttaatgcagaaatcgacggcgacgacatgattacgaaacaatattatgatattggtgtagctgtttctacagatgatggattattagtaccatttgtaagagattgtgataaaaagaattttgcagaaatcgaagcagaaattgctaatttagcagttaaagcacgagagaaaaaacttggcttagatgatatggttaatggttcatttacgattacaaatggcggtatttttggatcaatgatgagtacgccaattatcaatggtaatcaagctgcaatcttaggcatgcattcaattattacaagaccaattgcgattgatcaagatacaatcgaaaatcgtccaatgatgtatattgcattaagctatgatcatagaattattgacggtaaagaagcagttggattcttaaaaacaattaaagaattaattgaaaacccagaagacttattattagaatct

SEQ ID NO: 4548 - protein, 422 aa, Staphylococcus aureus
  MISC_FEATURE (1)..(422): dihydrolipoamide
MPEVKVPELAESITEGTIAEWLKNVGDSVEKGEAILELETDKVNVEVVSEEAGVLSEQLASEGDTVEVGQAIAIIGEGSGNASKENSNDNTPQQNEETNNKKEETTNNSVDKAEVNQANDDNQQRINATPSARRYARENGVNLAEVSPKTNDVVRKEDIDKKQQAPASTQTTQQASAKEEKKYNQYPTKPVIREKMSRRKKTAAKKLLEVSNNTAMLTTFNEVDMTNVMELRKRKKEQFMKDHDGTKLGFMSFFTKASVAALKKYPEVNAEIDGDDMITKQYYDIGVAVSTDDGLLVPFVRDCDKKNFAEIEAEIANLAVKAREKKLGLDDMVNGSFTITNGGIFGSMMSTPIINGNQAAILGMHSIITRPIAIDQDTIENRPMMYIALSYDHRIIDGKEAVGFLKTIKELIENPEDLLLES

SEQ ID NO: 4549 - DNA, 1383 bp, Staphylococcus aureus
atgtcagtaagaattgaacatgatacttttggagaaatagaagtacctgcagataaatattggggtgctcaaacagaaagaagtaaacgtaatttcccagttggtaaagagcgtatgccaatcgaagtagtttatggttttgcacaactaaagcgtgcagcagcaatagctaattttgatttaggaaaattaagcgaggcaaagaaagatgccattgtatacgcatgtgatcaaattttatcaggtgaattagatgaacacttcccactagttgtatggcaaacaggaagcggtacacaaagtaatatgaatgtgaacgaagtagtaagttatgttgctaatatgtatttaaaagatcatcaaagtgatgaaagtatccacccaaatgatgatgtaaataaatctcaaagttcgaatgatacattcccaactgctatgcacgttgcattatatcaagaggttgaaacaaaattagaacctgcattaaaacttttaagaaatactttgaaagaaaaagaagataaatttgattcaattattaaaattggtcgtacacatttacaagatgcaacgccgatcaaactaggacaagagattagtggctggcgttatatgcttgaccgttgtgaaacaatgttatctgaatctaagaagcacattttaaatcttgccatcggtggtacggctgttggtactggtattaatgcgcatcctgaatttggtgataaagtggcacattatatttcagaaaatacgggttatccatttgtatcttctgaaaataaattccacgcacttacagcgcatgatgaagttgttcaattgcatggaacattgaaggcattagcaggagacttaatgaaaattgctaatgatgtgagatggttggcttcagggccacgagctggtttggcagaaatttctatccctgaaaatgaaccaggttcatcaattatgcctggtaaagttaatcctacacaatgtgaaatgttaacaatggttgcagtccaagtaatgggtaatgatacagttgttggcttcgcaagttcacaaggtaactttgaattgaatgtttataaaccagttattatgcataatacactacaatcaatttatcttttagctgatggtatggaaacatttaataacaattgtgcagtgggcattgaaccaatcgaagagaatattgataattatttaaatcaatcattaatgttagttactgcattaaatccacatattggttatgaaaaagcagctcaaattgctaagaaagcccataaagaaggtttaactttaaaagaatctgcaattcaaactggatatgttacagaagaacaatttgaagcatggattaaaccagaagatatggtagatcctcat

SEQ ID NO: 4550 - protein, 461 aa, Staphylococcus aureus
  MISC_FEATURE (1)..(461): fumarate hydratase,
MSVRIEHDTFGEIEVPADKYWGAQTERSKRNFPVGKERMPIEVVYGFAQLKRAAAIANFDLGKLSEAKKDAIVYACDQILSGELDEHFPLVVWQTGSGTQSNMNVNEVVSYVANMYLKDHQSDESIHPNDDVNKSQSSNDTFPTAMHVALYQEVETKLEPALKLLRNTLKEKEDKFDSIIKIGRTHLQDATPIKLGQEISGWRYMLDRCETMLSESKKHILNLAIGGTAVGTGINAHPEFGDKVAHYISENTGYPFVSSENKFHALTAHDEVVQLHGTLKALAGDLMKIANDVRWLASGPRAGLAEISIPENEPGSSIMPGKVNPTQCEMLTMVAVQVMGNDTVVGFASSQGNFELNVYKPVIMHNTLQSIYLLADGMETFNNNCAVGIEPIEENIDNYLNQSLMLVTALNPHIGYEKAAQIAKKAHKEGLTLKESAIQTGYVTEEQFEAWIKPEDMVDPH

SEQ ID NO: 4551 - DNA, 861 bp, Staphylococcus aureus
atgattaaaataagttataatataatagtaaagataaagatagaggtggctataatgtgtggacttagaagtataacattaggtacaacaaatatagaacagacaaaacatttcatggttgacatattaggattaaattatgaagaacttcttgaaaactcaattcgtttcggcgatgcagatataagcccaggaacaagacttcaatttatacaagttccaagtgagcaattagaagaatctcactttgtgggtattggattacgtacaccaactgactcaggtttagaggagtatgcggaaatattatcgaataaggatattccatttacaacagttaaagaattaaatggcaataaatatttcagtctcgaagataacaatggtcatattttctcaatatattcaaacgagaataattatggcgttggtttaggtatgccttcttttgagagtgcggtcaatccgttacatcaagtgcaaggtttaggaccagtgattcttaaagtgaatcatgtagatattacaggtcaaattttaacaaatatattcggacttgaagtatttgcagaataccaacccttcgacaatgctgactatcatgtccaagtattcaaagttggaacgggtggtctaggtggcgaaatacatttaatgcctgtagaaaccgaaatgacaatgccggaatatggcgcagtcgatcaagttgagtttgaaacgaaagatgcagatttctttaatcaagcgaaatcgcgcttagatgaagtggaaataccatatcaaacgcttgagcaagatgatattgaatcaattagaattactgaaaacagtggattatcgtttatattcactttacaaaaa

SEQ ID NO: 4552 - protein, 287 aa, Staphylococcus aureus
  MISC_FEATURE (1)..(287): ABC transporter homolog
MIKISYNIIVKIKIEVAIMCGLRSITLGTTNIEQTKHFMVDILGLNYEELLENSIRFGDADISPGTRLQFIQVPSEQLEESHFVGIGLRTPTDSGLEEYAEILSNKDIPFTTVKELNGNKYFSLEDNNGHIFSIYSNENNYGVGLGMPSFESAVNPLHQVQGLGPVILKVNHVDITGQILTNIFGLEVFAEYQPFDNADYHVQVFKVGTGGLGGEIHLMPVETEMTMPEYGAVDQVEFETKDADFFNQAKSRLDEVEIPYQTLEQDDIESIRITENSGLSFIFTLQK

SEQ ID NO: 4553 - DNA, 201 bp, Staphylococcus aureus
atgttacatgaaacttggaaagaacgtacaccaatcaagaaagtagaagtcattaatacagatgcaaagaaatttacagtttctgacatgttaacggttggcaaacaatatgatgttatcaacgaaactgaagaatattatcaaataatagataattctggattagttggcggttactataaaacatatttcaaagaagtt

SEQ ID NO: 4554 - protein, 67 aa, Staphylococcus aureus
  MISC_FEATURE (1)..(67): conserved hypothetical
MLHETWKERTPIKKVEVINTDAKKFTVSDMLTVGKQYDVINETEEYYQIIDNSGLVGGYYKTYFKEV

SEQ ID NO: 4555 - DNA, 789 bp, Staphylococcus aureus
atggcactaaaacattataagaattcagattcaacagttttcaatgatgcgaaggcattatttgatttaaataaaaatattttacttaaaggtccaacaggttcagggaaaacaaagttggcagaaacattaagtgaagttgttgatacacccatgcatcaagtcaattgttctgttgatttagatacagaaagcttattaggctttaaaacaattaaaacaaatgcggaaggtcaacaagaaattgtctttgtagatggtccagttattaaagctatgaaagaggggcatattttatatattgatgaaataaatatggctaaacctgaaacattgcctgtattaaatggggtcttagattatcgtcgtcaaattacgaatccatacactggtgaagtaatcaaagctgtaccaggatttaacgttatagcagcgataaatgaaggttatgttggtactttgccaatgaatgaagcactaaaaaatcgctttgttgttattcacgttgattatattgatggggacattttaaaaaatgtgattaaagagcaaagtttattacaagatgataaacaaatcgaacaaattattaagtttaatgaagatttacgtactatgtctaagcagggacaaatttctgaagaagccgctagtatccgtgcattattagacttgtgtgatttaatcactgtaatgccagttgaacgtgcaattaaacgtacaattattgataaattggaagatgaacgtgaacaacaagcaatatataatgctgtagaactaaacttt

SEQ ID NO: 4556 - protein, 263 aa, Staphylococcus aureus
  MISC_FEATURE (1)..(263): hypothetical protein
MALKHYKNSDSTVFNDAKALFDLNKNILLKGPTGSGKTKLAETLSEVVDTPMHQVNCSVDLDTESLLGFKTIKTNAEGQQEIVFVDGPVIKAMKEGHILYIDEINMAKPETLPVLNGVLDYRRQITNPYTGEVIKAVPGFNVIAAINEGYVGTLPMNEALKNRFVVIHVDYIDGDILKNVIKEQSLLQDDKQIEQIIKFNEDLRTMSKQGQISEEAASIRALLDLCDLITVMPVERAIKRTIIDKLEDEREQQAIYNAVELNF

SEQ ID NO: 4557 - DNA, 1884 bp, Staphylococcus aureus
atgagtgatcgtttcataaaatttaatgacgaacagttagatgccaagcaagtaatgatgttgcaagacttagctcgactcttattaaaaaatgaacaaacacaagttaaaatccaaaaattcccttactataatcctgttcaaaatgttttgattacgagttggttttggtcacatcgaccaagccatatcgaaatggctggtttaaaaacagatgttatgttagctgcttacggttatcatatgatggatgtacaaattgtaaatgaagtagtacaagataaaacttttaaacaccctaaattttatcaacaactttttaaattattagaagatatgcgcgtattaaattctattaaagttgagcgcccaagtactgctaaattaattgatcttcgcttagatacacgtatatcatatacggaatctcaaattaaagtgtatcgtactaaaacacaatatacagatttattatttttgtatttagaacatgcatttttaagccaagatttctttgatataccatctatacattcagatttagatgatattttagtaaatatgttcttatatttacctaattttttccaaaatcaaaattctgaagataatatgtatctggctcaaagaattatgtatcaagtagatgatattttaaaagaagatatgctaaacgaatattattacttacctaaaacactatataatacattagctagtccagagtttgatgatttaaagagaactgatgcaagtcaagtcgatgggcaagatgatacttcagaagatgatgataacgaaagtgaaaaagctgactctaaatctgcagatagtgagtcaaaaggtggcgcctatttagaaatggagcttcacgaaggacaaaatagtgaaacattaggtaatgatgaagcacgtgaaggcgatgctacagatgatatgactgatatgatgaccaaaaagggcaaaggatcaaacgatacgctaaatcgtgaagaaggcgatgctgttggtcaaagccaagcatttcaacttgatggtgtgaacaaaaatgtagaaataaaatggcaaattcctgaaattgagccacaatatgttttagaatatcaagaatcgaaacaagacgtacaatatgaaatcaaagacttaattcaaattataaagaaaacgattgaacgagaacaacgagatgcacgttttaatttaacaaaagggcgattacaaaaggatttaattaattggtttatcgacgatcaatataaattgttttacaaaaaacaagatttaagtaaatcatttgatgcgacatttacattgttaattgatgcgtcagcaagtatgcatgataaaatggctgaaacgaagaaaggtgtagtgttattccacgagacgttaaaagcattgaacattaaacatgaaattttatcattcagtgaggatgcctttgattcagacgagcatgcacaaccaaatatcattaatgaaattattaactatgattactcaacctttgaaaaagatggcccacgtattatggcacttgaacctcaagatgataatcgtgatggtgttgctattagagttgcaagtgaacgattaatgcgtcgaaatcaacatcaacgatttttaatcgtattttcagacggcgaaccgtctgcatttaattatagtcaagatggtattattgatacgtatgaagctgtagaaatgtcacgtaaatttggtattgaagtatttaatgtatttttgagtcaagatccaataactgaagatgttgaacaaacaattcataatatttatggtcaatatgctattttcgttgaaggtgttgcgcatttacctggacatctctctccattattaaaaaaattactacttaaatcttta

SEQ ID NO: 4558 - protein, 628 aa, Staphylococcus aureus
  MISC_FEATURE (1)..(628): conserved hypothetical
MSDRFIKFNDEQLDAKQVMMLQDLARLLLKNEQTQVKIQKFPYYNPVQNVLITSWFWSHRPSHIEMAGLKTDVMLAAYGYHMMDVQIVNEVVQDKTFKHPKFYQQLFKLLEDMRVLNSIKVERPSTAKLIDLRLDTRISYTESQIKVYRTKTQYTDLLFLYLEHAFLSQDFFDIPSIHSDLDDILVNMFLYLPNFFQNQNSEDNMYLAQRIMYQVDDILKEDMLNEYYYLPKTLYNTLASPEFDDLKRTDASQVDGQDDTSEDDDNESEKADSKSADSESKGGAYLEMELHEGQNSETLGNDEAREGDATDDMTDMMTKKGKGSNDTLNREEGDAVGQSQAFQLDGVNKNVEIKWQIPEIEPQYVLEYQESKQDVQYEIKDLIQIIKKTIEREQRDARFNLTKGRLQKDLINWFIDDQYKLFYKKQDLSKSFDATFTLLIDASASMHDKMAETKKGVVLFHETLKALNIKHEILSFSEDAFDSDEHAQPNIINEIINYDYSTFEKDGPRIMALEPQDDNRDGVAIRVASERLMRRNQHQRFLIVFSDGEPSAFNYSQDGIIDTYEAVEMSRKFGIEVFNVFLSQDPITEDVEQTIHNIYGQYAIFVEGVAHLPGHLSPLLKKLLLKSL

SEQ ID NO: 4559 - DNA, 1341 bp, Staphylococcus aureus
atgaataaaaatacatgggtcattgggtttacgctcttcgctatgttttttggcgcaggcaatctaatttttcctcctaatctcggattggatagtggtcaatttttctggcccgccattttagcgtttgttctaactgggattggtttaccattattaggtgtgattgtaggtgcacttgataaagaaggatatattggcgcattaaataaaatttcacctaaattttcaatattgttcttaatcatcatttatttgactataggaccactttttgcaatacctagaactgcatctacatcttttgaaatgacaattacaccaattatacatagcaatagtagtatcgctttatttatatttacgattatctacttcatagtcgttttgtatatttgtttaaatccatctaagttaatcgatcgtattggttcattattaacaccattattattgattactattttagcgatgattattaaaggatacttagactttagcggtaatagtgctggaaagggcaatgaagcactatatcattctaatttttcaagttttgctgaaggctttacacaaggctatttaacaatggatgccattgcagcaattgctttttcaatgattgttgttaatgcagtaaaactaacaggcattactaaaacaaatcaaatattcaaacaaactttgactgctggtttaattgcagccgtagctttaattttcatatatatttcattaggttatattggtaatcatatgccagtaagtgacatgacgttagatcaattgaaatccaaagatcgaaacattgggacatatttattaacgacaatggcttcaacaggatttggttcattcggaaaatatttattgggcatcattgtggcgctggcatgtctaactacagcatgcgggcttattgttgcagtttctgaatatttccatagaatcgtacctaaagtatcatacaaagcatttgtattagttttcattttaatgagttttattattgctaaccaaggtttaaatgctgttatctcaatgtcaattccggtattaagcattgtatacccagtagcaataactgttgtattattaattttaattgccaaattcataccgacaaaacgcatttcacaacaaattccagttattatcgtatttatattgtcgattttcagtgttattagtaagttaggttggctgaaaattaactttatagaatcattgcctctaagagcgtattctttagagtggttcccagtagcaattattgcaacgatattaggctatctagtcggcatatttgtaaaacaagatccaattaaatatcaacaggaa

SEQ ID NO: 4560 - protein, 447 aa, Staphylococcus aureus
  MISC_FEATURE (1)..(447): branched-chain amino acid
MNKNTWVIGFTLFAMFFGAGNLIFPPNLGLDSGQFFWPAILAFVLTGIGLPLLGVIVGALDKEGYIGALNKISPKFSILFLIIIYLTIGPLFAIPRTASTSFEMTITPIIHSNSSIALFIFTIIYFIVVLYICLNPSKLIDRIGSLLTPLLLITILAMIIKGYLDFSGNSAGKGNEALYHSNFSSFAEGFTQGYLTMDAIAAIAFSMIVVNAVKLTGITKTNQIFKQTLTAGLIAAVALIFIYISLGYIGNHMPVSDMTLDQLKSKDRNIGTYLLTTMASTGFGSFGKYLLGIIVALACLTTACGLIVAVSEYFHRIVPKVSYKAFVLVFILMSFIIANQGLNAVISMSIPVLSIVYPVAITVVLLILIAKFIPTKRISQQIPVIIVFILSIFSVISKLGWLKINFIESLPLRAYSLEWFPVAIIATILGYLVGIFVKQDPIKYQQE

SEQ ID NO: 4561 - DNA, 390 bp, Staphylococcus aureus
atgtataaaaattataacatgacccaacttacactaccaatagaaacttctgttagaattcctcaaaatgataatacgcgatatgttaatgaaattgttgaaacgatatctgatagcgaattcgatgaatttatatgtcctaataacaaaagaataggttttaaaagatatgcataccgtaatgatagatatagttttaaacgtgacttcaagctatatgaatgtgatgactgttcatcatgttctttgagacatcaatgcatgaagccaaattcgaaatccaataagaaaattatgaagaattataattgggaatactttaaagcccaaattaatcaaaagctttctgaaccagaaacgaaaaaatctatagtcaaagaaaaattgatg

SEQ ID NO: 4562 - protein, 130 aa, Staphylococcus aureus
  MISC_FEATURE (1)..(130): truncated transposase
MYKNYNMTQLTLPIETSVRIPQNDNTRYVNEIVETISDSEFDEFICPNNKRIGFKRYAYRNDRYSFKRDFKLYECDDCSSCSLRHQCMKPNSKSNKKIMKNYNWEYFKAQINQKLSEPETKKSIVKEKLM

SEQ ID NO: 4563 - DNA, 114 bp, Staphylococcus aureus
atggcacttaatataaggaaaatagcagctcaacgagctgtacattataaaatacatatcaaaaaagctgatttctatcaaataaataatagaaatcagcttttttacattgcc

SEQ ID NO: 4564 - protein, 38 aa, Staphylococcus aureus
  MISC_FEATURE (1)..(38): truncated transposase
MALNIRKIAAQRAVHYKIHIKKADFYQINNRNQLFYIA

SEQ ID NO: 4565 - DNA, 1137 bp, Staphylococcus aureus
ttgatgactgaaaataaaagtttcaaagaaagccatccactagatgattttataagcgataaagaattatcgaatactactattcaaaaagaaaagttaacaattgaacaacaaaaacaggtagacacaatcagtaaacaaattaaccctttagacaatgaaggtttattagcgtttggttctgatttacagaaacaaatgtctcaattttcacatcaaatgttggatgaagtacaaagtaaagatgttggtcctattggagatactttgtcagatctaatgtcaaaactaaagtcagttaatccaaatgagttaaatactgataaaccatctatgttaaaaagaatttttagcagagcaaagtcgtctatcaatgaaatcttttcaagaatgcaatcagttagtgctcaagtcgatcgcataacgattcaactgcagaaacatcaaacacatttaacaagagatattgaattattagatacgctatatgataaaaacaaacaatactttgatgacttatcattgcatatcattgctgcacagcaaaaaaagttgcaattagaaaatgaaaagctaccacaattgcaacagcaagcgcagcaatccactaatcaaatggatattcaacaagttgcagatatgcagcaatttatagatagactagataaacgcatatatgacttacagctttcaagacaaatagctttgcaaactgcgccacaaattcgtatgattcaaaatgttaatcaagcacttgccgagaagatacaaagttcaattttgacaagtattccactatggaaaaatcaaatggccattgcgcttacattaatgagacagcgtaatgcagttgctgcacaacgagctgtcactgatacaactaatgatttattaacagcaaatgctgaaatgttgaaacaaaatgcgattgaaactgcaacagaaaatgagcgtggcattgttgatcttgatacattgaaacgtacacagcgtaacattattgagacaattgaagaaacattaattattcaacaacacggtcgcgaagaacgacaattagctgaaaaagaattacaacaattagaacaagatttaaagtcacatttagtgaacatcaaaggaccgaataaacaatca

SEQ ID NO: 4566 - protein, 379 aa, Staphylococcus aureus
  MISC_FEATURE (1)..(379): hypothetical protein
LMTENKSFKESHPLDDFISDKELSNTTIQKEKLTIEQQKQVDTISKQINPLDNEGLLAFGSDLQKQMSQFSHQMLDEVQSKDVGPIGDTLSDLMSKLKSVNPNELNTDKPSMLKRIFSRAKSSINEIFSRMQSVSAQVDRITIQLQKHQTHLTRDIELLDTLYDKNKQYFDDLSLHIIAAQQKKLQLENEKLPQLQQQAQQSTNQMDIQQVADMQQFIDRLDKRIYDLQLSRQIALQTAPQIRMIQNVNQALAEKIQSSILTSIPLWKNQMAIALTLMRQRNAVAAQRAVTDTTNDLLTANAEMLKQNAIETATENERGIVDLDTLKRTQRNIIETIEETLIIQQHGREERQLAEKELQQLEQDLKSHLVNIKGPNKQS

SEQ ID NO: 4567 - DNA, 627 bp, Staphylococcus aureus
atgacagtgagatataatatttctcatatatttggggtgttagtgggaattcctgtagcgtttttaacaagcatatttgggatgattgcacttgatgtatcttttttaattgatatgtctattggtattgttggctttttaatgacatacctaccgatacaaaaactcacttcacgcaaatatttaaacgaaattggtttgactagaaaagactatcgctatattcgaaatcagttaaatcatacacaccaaaaacttagaggtattttaaaaacgtatgtcaatataagatcaattaaagattttaggcagattaatgatatataccaaatttcacgttctatttatacgacagttagacagagacctgcatcattttataaagttgaaggctttttttattctcatattgataatgctttaaatttggttgatgcatatacacgtctagcaaaaatgcccaaaaaatcaattaatgaacagcaaaagttagaacaaacacgaattactttggatgaggtcaaacgaacattaatcgctgatttaaagcgtctcaacgaagatgattatgaacgtttagatattgaaatggaattaaataagttacatcaaaaacatcatcaagat

SEQ ID NO: 4568 - protein, 209 aa, Staphylococcus aureus
  MISC_FEATURE (1)..(209): hypothetical protein
MTVRYNISHIFGVLVGIPVAFLTSIFGMIALDVSFLIDMSIGIVGFLMTYLPIQKLTSRKYLNEIGLTRKDYRYIRNQLNHTHQKLRGILKTYVNIRSIKDFRQINDIYQISRSIYTTVRQRPASFYKVEGFFYSHIDNALNLVDAYTRLAKMPKKSINEQQKLEQTRITLDEVKRTLIADLKRLNEDDYERLDIEMELNKLHQKHHQD

SEQ ID NO: 4569 - DNA, 276 bp, Staphylococcus aureus
gtggtaaaaatgagacatatacatttacaagtattcggacgcgttcaaggcgtcggatttagatattttacacaacgcattgcaatgaactataacattgtcggtactgttcaaaatgtagatgactatgtagagatatatgcacaaggggatgacgcatatatagagagatttattcaaggtgtaattgaaggtgcctcaccagcatcaaatgtaacaagccatcaacttgaagagttagaactaaatcaaaaattatcggattttcgatcaata

SEQ ID NO: 4570 - protein, 92 aa, Staphylococcus aureus
  MISC_FEATURE (1)..(92): conserved hypothetical
VVKMRHIHLQVFGRVQGVGFRYFTQRIAMNYNIVGTVQNVDDYVEIYAQGDDAYIERFIQGVIEGASPASNVTSHQLEELELNQKLSDFRSI

SEQ ID NO: 4571 - DNA, 420 bp, Staphylococcus aureus
atgaaattagaggagatttatatatttatgttaggaaaatactggattcaattattgatagcaacagttattataagtttaatatcaattaaagcttttccattggcaattggggcattatatttacctgttattttcaaagtaataaaattacaactcaatttatcaaaaggattaattgatgatgttaatgcgcaaacattcattaaaagtaatcaatcaggtattgtaatcagtgtaatttgttgtttattaataacagcaatattgtattatacacttgatgggttttatgcgagtttaacaggagttttaggtacgcttgttgctctaaatccatatacgacaattgttagtgctgtattatatatacttacagctattgctacggttgaagctactaaaacaaagtatcgtaat

SEQ ID NO: 4572 - protein, 140 aa, Staphylococcus aureus
  MISC_FEATURE (1)..(140): hypothetical protein
MKLEEIYIFMLGKYWIQLLIATVIISLISIKAFPLAIGALYLPVIFKVIKLQLNLSKGLIDDVNAQTFIKSNQSGIVISVICCLLITAILYYTLDGFYASLTGVLGTLVALNPYTTIVSAVLYILTAIATVEATKTKYRN

SEQ ID NO: 4573 - DNA, 324 bp, Staphylococcus aureus
gtgtgcggcttaaagctgcacgcacataataagaagggaggcgcccaaatggctcgtagtattaaaaaaggacctttcgtcgatgagcatttaatgaaaaaagttgaagctcaagaaggaagcgaaaagaaacaagtaatcaaaacatggtcacgtcgttctacaattttccctaatttcatcggacatacttttgcagtatacgacggacgtaaacacgtacctgtatatgtaactgaagatatggtaggtcataaattaggtgagtttgctcctactcgtacattcaaaggacacgttgcagacgacaagaaaacaagaaga

SEQ ID NO: 4574 - protein, 108 aa, Staphylococcus aureus
  MISC_FEATURE (1)..(108): 30S ribosomal protein S19
VCGLKLHAHNKKGGAQMARSIKKGPFVDEHLMKKVEAQEGSEKKQVIKTWSRRSTIFPNFIGHTFAVYDGRKHVPVYVTEDMVGHKLGEFAPTRTFKGHVADDKKTRR

SEQ ID NO: 4575 - DNA, 360 bp, Staphylococcus aureus
atgtctggagtaattaattatcaattccgtttaaatggtgttttaatatttaaaattgaacttttgatatattactatgtctggtacacaaatcaatgttttatgctttacaaagttatattggcagtagttgactgcagtccacaacatagaggcttcggaatgtcagcttctatttcatgcaagttggtggagctccaacatagtggaattggattcccaatttctacagacattgcaaattggggaaacgggccacaaactcagaaactggtggaaagtcagcttaaaataacatgcaagttggcgaggccccaaaatagtgagatcggatttctaatttctacagacattgcaaat

SEQ ID NO: 4576 - protein, 120 aa, Staphylococcus aureus
MSGVINYQFRLNGVLIFKIELLIYYYVWYTNQCFMLYKVILAVVDCSPQHRGFGMSASISCKLVELQHSGIGFPISTDIANWGNGPQTQKLVESQLKITCKLARPQNSEIGFLISTDIAN

SEQ ID NO: 4577 - DNA, 306 bp, Staphylococcus aureus
atgtggacagttaccaaaattagagccgattatgagggatggtggttattcagtgactggccagaaaacattgttgaaaaatatcaatatcaagattttgatgacatgtttaagcactatcaacaattgattaatcaatgtaaagttcagttcgataactatgtcacaggcaaatataatatttatgcattttataataattgtgacatgaactattgcgaagattgtgaagaggatttacaaatattttatagtttcattgttttacaaaataatgaagtatattataaactaccaataattgat

SEQ ID NO: 4578 - protein, 102 aa, Staphylococcus aureus
  MISC_FEATURE (1)..(102): conserved hypothetical
MWTVTKIRADYEGWWLFSDWPENIVEKYQYQDFDDMFKHYQQLINQCKVQFDNYVTGKYNIYAFYNNCDMNYCEDCEEDLQIFYSFIVLQNNEVYYKLPIID

SEQ ID NO: 4579 - DNA, 861 bp, Staphylococcus aureus
atgggtacaactgaaattaaagggaaaccaaagcgtgttgttacgctatatcaaggtgccactgacgtcgctgtatctttaggtgttaaacctgtaggtgctgtagaatcatggacacaaaaaccgaaattcgaatacataaaaaatgatttaaaagatactaagattgtaggtcaagaacctgcacctaacttagaggaaatctctaaattaaaaccggacttaattgtcgcgtcaaaagttagaaatgaaaaagtttacgatcaattatctaaaatcgcaccaacagtttctactgatacagttttcaaattcaaagatacaactaagttaatggggaaagctttagggaaagaaaaagaagctgaagatttacttaaaaagtacgatgataaagtagctgcattccaaaaagatgcaaaagcaaagtataaagatgcatggccattgaaagcttcagttgttaacttccgtgctgatcatacaagaatttatgctggtggatatgctggtgaaatcttaaatgatttaggattcaaacgtaataaagacttacaaaaacaagttgataatggtaaagatattatccaacttacatctaaagaaagcattccattaatgaacgctgatcatatttttgtagtaaaatcagatccaaatgcgaaagatgctgcattagttaaaaagactgaaagcgaatggacttcaagtaaagagtggaaaaatttagacgcagttaaaaacaaccaagtatctgatgatttagatgaaatcacttggaacttagctggcggatataaatcttcattaaaacttattgacgatttatatgaaaagttaaatattgaaaaacaatcaaaa

SEQ ID NO: 4580 - protein, 287 aa, Staphylococcus aureus
  MISC_FEATURE (1)..(287): lipoprotein [Staphylococcus
MGTTEIKGKPKRVVTLYQGATDVAVSLGVKPVGAVESWTQKPKFEYIKNDLKDTKIVGQEPAPNLEEISKLKPDLIVASKVRNEKVYDQLSKIAPTVSTDTVFKFKDTTKLMGKALGKEKEAEDLLKKYDDKVAAFQKDAKAKYKDAWPLKASVVNFRADHTRIYAGGYAGEILNDLGFKRNKDLQKQVDNGKDIIQLTSKESIPLMNADHIFVVKSDPNAKDAALVKKTESEWTSSKEWKNLDAVKNNQVSDDLDEITWNLAGGYKSSLKLIDDLYEKLNIEKQSK

SEQ ID NO: 4581 - DNA, 993 bp, Staphylococcus aureus
atgctacttaaaccaaaataccaaatcgttattgctggtttatgtcttgcaatagtagctatcttaagtttaatgattggaaatacgcttgtgtcaccaggtacggtgatacaggcgttattcaactttgatagtgaaaacgatttacatgatgttgtcactggtgcacgggcgtcgagaacaatcattgcgttattgactggtgctgcccttgctgtctcaggtttgttgatgcaagcacttacacgaaacccaatagcctcaccagggcttttcggtgtcaatgcaggcgcagtattttttgtcatttttagtattacatttatccaaattcaatcttttaaaatgattgtagttattgcatttttgggggctattgttgttactgtattagttgttgcactaggtatgtttagacaaacactattctcacctcaccgtgtcattttggcaggtgctgcgattgcgatgctatttacagcctttactcaaggcatacttattatgaacgaaacagacttacaaggcctattattttggttaagtggctccgtttcattacgtaatatttgggatatcccatggattattccgcttgtattgatacttattttaattgcatttagcatggctgcacacatcaacatcttgatgacaagtgacgacattgcaaccggcctcggtcaaaacataaaattaatcaaatggatgattattatgctcatcagtatgttagccggtatttcggtagccgtagctggatcaatcgtctttgtgggtcttatcgtaccgaatattagcaaacgattattaccaccaaactataagtatttaattccttttactgcattagctggagcaatcctaatgatcatttcagacattgttgctcgtataataattaagccactagagttgcctatcggtgtcgttaccgctgtcattggcgctattgtcttaatctatattatgaagaaaggacgtcaacgctta

SEQ ID NO: 4582 - protein, 331 aa, Staphylococcus aureus
  MISC_FEATURE (1)..(331): lipoprotein [Staphylococcus
MLLKPKYQIVIAGLCLAIVAILSLMIGNTLVSPGTVIQALFNFDSENDLHDVVTGARASRTIIALLTGAALAVSGLLMQALTRNPIASPGLFGVNAGAVFFVIFSITFIQIQSFKMIVVIAFLGAIVVTVLVVALGMFRQTLFSPHRVILAGAAIAMLFTAFTQGILIMNETDLQGLLFWLSGSVSLRNIWDIPWIIPLVLILILIAFSMAAHINILMTSDDIATGLGQNIKLIKWMIIMLISMLAGISVAVAGSIVFVGLIVPNISKRLLPPNYKYLIPFTALAGAILMIISDIVARIIIKPLELPIGVVTAVIGAIVLIYIMKKGRQRL

SEQ ID NO: 4583 - DNA, 846 bp, Staphylococcus aureus
atggatcaattcactttagaagtattacgcttacctcgcattacacttgcgattttagcaggtgccgcactaggaatgagtggtttaatgttgcaaaatgtattaaaaaatccaattgcctcacctgatattatcggtatcacaggtggtgctagcttaagtgctgttgtctttattgcatttttcagccatttaacaatacatttacttccactatttgcagtattaggtggcgcagttgcaatgatgatactattagtgtttcaaacgaaaggacaaatacgcccgacaacactcataatcatcggtatttcgatgcaaacgttgtttattgcgcttgtccaaggattactcattacaacgaagcaattatctgctgccaaagcttatacatggctagtcggaagtctttacggtgctacgtttaaagatacaatcattttgggtatggttattttagctgttgtgccgttgttatttcttgttataccaaaaatgaaaatatctatacttgatgaccctgtagcgattggcttaggcttacatgtacaacgtatgaaactaatccaattaatcacttctactatactcgtatctatggcaatcagtttagtaggtaacattgggtttgtcggtttaatcgcaccacatatcgcgaaaacaatcgttcgcggaagttatgctaaaaagttactaatgtcagcaatgattggtgccatatcaattgttattgcagacttaattgggcgtaccttattcttgcctaaagaagtgccagcaggtgtatttattgctgcttttggtgccccattcttcatatacttattattaaccgtgaaaaagtta

SEQ ID NO: 4584 - protein, 282 aa, Staphylococcus aureus
  MISC_FEATURE (1)..(282): lipoprotein [Staphylococcus
MDQFTLEVLRLPRITLAILAGAALGMSGLMLQNVLKNPIASPDIIGITGGASLSAVVFIAFFSHLTIHLLPLFAVLGGAVAMMILLVFQTKGQIRPTTLIIIGISMQTLFIALVQGLLITTKQLSAAKAYTWLVGSLYGATFKDTIILGMVILAVVPLLFLVIPKMKISILDDPVAIGLGLHVQRMKLIQLITSTILVSMAISLVGNIGFVGLIAPHIAKTIVRGSYAKKLLMSAMIGAISIVIADLIGRTLFLPKEVPAGVFIAAFGAPFFIYLLLTVKKL

SEQ ID NO: 4585 - DNA, 774 bp, Staphylococcus aureus
gtgcatatacaaggagataaaacaatgaaatataataaccatgacaaaattagagattttataatcattgaagcatatatgtttcgttttaagaaaaaagtcaagcctgaagtcgatatgactataaaagaatttatattactgacttatttatttcatcagcaagaaaacacacttccatttaagaagattgtttcagatttatgttataaacaatcggatttagtacagcatataaaagtacttgtgaaacattcatatattagtaaagttcgaagtaaaattgatgagcgtaatacttacatttcaatatctgaagaacaacgagagaaaattgcagaacgtgttacattgtttgatcaaatcattaaacaatttaaccttgcagatcaaagtgaatcacagatgataccaaaagatagtaaagaatttctaaacttgatgatgtatacaatgtatttcaagaatattatcaaaaaacatctaacattaagttttgtagaattcacaattctagctattatcacttctcaaaataaaaacatcgttcttcttaaagatttaattgaaacaatccaccataaataccctcaaactgttagagctctcaataatttaaaaaagcaaggctatctaataaaagaacgctcaactgaagatgaaagaaaaattttaattcatatggatgacgcgcagcaagaccatgctgaacaattattagctcaagtgaatcaattattagcagataaagatcatttacatcttgtttttgaa

SEQ ID NO: 4586 - protein, 258 aa, Staphylococcus aureus
  MISC_FEATURE (1)..(258): staphylococcal accessory
VHIQGDKTMKYNNHDKIRDFIIIEAYMFRFKKKVKPEVDMTIKEFILLTYLFHQQENTLPFKKIVSDLCYKQSDLVQHIKVLVKHSYISKVRSKIDERNTYISISEEQREKIAERVTLFDQIIKQFNLADQSESQMIPKDSKEFLNLMMYTMYFKNIIKKHLTLSFVEFTILAIITSQNKNIVLLKDLIETIHHKYPQTVRALNNLKKQGYLIKERSTEDERKILIHMDDAQQDHAEQLLAQVNQLLADKDHLHLVFE

SEQ ID NO: 4587 - DNA, 1608 bp, Staphylococcus aureus
ttgcaatacataattcgttatattatgatgactttacaaatacatacagggggtattaatttgaaaaagaaaaacatttattcaattcgtaaactaggtgtaggtattgcatctgtaactttaggtacattacttatatctggtggcgtaacacctgctgcaaatgctgcgcaacacgatgaagctcaacaaaatgctttttatcaagtcttaaatatgcctaacttaaatgctgatcaacgcaatggttttatccaaagccttaaagatgatccaagccaaagtgctaacgttttaggtgaagctcaaaaacttaatgactctcaagctccaaaagctgatgcgcaacaaaataacttcaacaaagatcaacaaagcgccttctatgaaatcttgaacatgcctaacttaaacgaagcgcaacgtaacggcttcattcaaagtcttaaagacgacccaagccaaagcactaacgttttaggtgaagctaaaaaattaaacgaatctcaagcaccgaaagctgataacaatttcaacaaagaacaacaaaatgctttctatgaaatcttgaatatgcctaacttaaacgaagaacaacgcaatggtttcatccaaagcttaaaagatgacccaagccaaagtgctaacctattgtcagaagctaaaaagttaaatgaatctcaagcaccgaaagcggataacaaattcaacaaagaacaacaaaatgctttctatgaaatcttacatttacctaacttaaacgaagaacaacgcaatggtttcatccaaagcctaaaagatgacccaagccaaagcgctaaccttttagcagaagctaaaaagctaaatgatgctcaagcaccaaaagctgacaacaaattcaacaaagaacaacaaaatgctttctatgaaattttacatttacctaacttaactgaagaacaacgtaacggcttcatccaaagccttaaagacgatccttcagtgagcaaagaaattttagcagaagctaaaaagctaaacgatgctcaagcaccaaaagaggaagacaataacaagcctggcaaagaagacaataacaagcctggcaaagaagacaacaacaagcctggtaaagaagacaacaacaagcctggtaaagaagacaacaacaagcctggcaaagaagacggcaacaagcctggtaaagaagacaacaaaaaacctggtaaagaagatggcaacaagcctggtaaagaagacaacaaaaaacctggtaaagaagacggcaacaagcctggcaaagaagatggcaacaaacctggtaaagaagatggtaacggagtacatgtcgttaaacctggtgatacagtaaatgacattgcaaaagcaaacggcactactgctgacaaaattgctgcagataacaaattagctgataaaaacatgatcaaacctggtcaagaacttgttgttgataagaagcaaccagcaaaccatgcagatgctaacaaagctcaagcattaccagaaactggtgaagaaaatccattcatcggtacaactgtatttggtggattatcattagccttaggtgcagcgttattagctggacgtcgtcgcgaacta

SEQ ID NO: 4588 - protein, 536 aa, Staphylococcus aureus
  MISC_FEATURE (1)..(536): Immunoglobulin G binding
LQYIIRYIMMTLQIHTGGINLKKKNIYSIRKLGVGIASVTLGTLLISGGVTPAANAAQHDEAQQNAFYQVLNMPNLNADQRNGFIQSLKDDPSQSANVLGEAQKLNDSQAPKADAQQNNFNKDQQSAFYEILNMPNLNEAQRNGFIQSLKDDPSQSTNVLGEAKKLNESQAPKADNNFNKEQQNAFYEILNMPNLNEEQRNGFIQSLKDDPSQSANLLSEAKKLNESQAPKADNKFNKEQQNAFYEILHLPNLNEEQRNGFIQSLKDDPSQSANLLAEAKKLNDAQAPKADNKFNKEQQNAFYEILHLPNLTEEQRNGFIQSLKDDPSVSKEILAEAKKLNDAQAPKEEDNNKPGKEDNNKPGKEDNNKPGKEDNNKPGKEDNNKPGKEDGNKPGKEDNKKPGKEDGNKPGKEDNKKPGKEDGNKPGKEDGNKPGKEDGNGVHVVKPGDTVNDIAKANGTTADKIAADNKLADKNMIKPGQELVVDKKQPANHADANKAQALPETGEENPFIGTTVFGGLSLALGAALLAGRRREL

SEQ ID NO: 4589 - DNA, 1590 bp, Staphylococcus aureus
atgacactacttactgtaaatccattcgataatgtcggattatcagccttagttgcagcagtacctattattttatttttattatgcttaaccgtttttaaaatgaaaggcatttatgcagcattgacaactttggttgttacattgattgtggctttatttgtatttgaattaccagcgcgtgtatcagcaggtgcgattacagaaggcgttgttgccggtattttcccaataggatatatcgttttaatggcagtttggttatataaagtttctattaaaacaggacaattttctattattcaagatagtattgcaagtatttcagtggaccaaagaatccaactattattaattggattttgtttcaacgcatttttagaaggtgcagcaggatttggtgtgccaattgcgatttgtgcagtattattaattcaacttggatttgaaccattaaaagcagcgatgttatgtttaattgctaatggtgcggcgggtgcctttggtgcaattggtttaccagttagtattattgatacgtttaacttaagtggaggcgttacaacattagatgttgcgagatactcagcattaacacttccaattttaaactttattattccatttgttttagtattcattgtagatggtatgaaaggtattaaagaaattttacctgtcattttaacagtgagtggtacatatactggattacaattattattaacaatattccatggtccagaactagcagacattattccatcactagcaacaatggtggtgttagcatttgtttgtcgtaaatttaaaccgaaaaacattttcagattggaagcgtctgaacataaaattcaaaaacgaacgcctaaagaaattgtctttgcttggagtccgttcgtaattttaactgcctttgtattagtatggagtgcaccattcttcaaaaaattattccaacctggaggtgcacttgaaagtttagtaataaaattgccaattccaaatactgtgagtgatttatcgcctaaaggaattgcgttgcgtctcgatttaattggtgcaactgggacagcgattttattaacagtaattattacaattttaattacgaagttaaaatggaaaagtgcaggtgctttattggtcgaagcaattaaagaattatggttaccgatccttacaatttcagctatcctagctattgctaaagttatgacatacggtggtttgactgtagcaattggacaaggtattgctaaagcgggagcaattttcccattattctctccagtattaggttggattggtgtgtttatgactggttcagttgtaaataacaatactttattcgcacctattcaagcgacagtggcacaacaaatttcaacaagcggttcattacttgtggcagctaacactgcaggtggtgtagcagcgaaacttatttcaccacaatcaattgccattgcgactgcagctgttaaaaaagttggtgaagaatctgcattattaaaaatgacgttaaaatacagtattatatttgttgcttttatttgtgtttggacgtttatactaacgttaatattc

SEQ ID NO: 4590 - protein, 530 aa, Staphylococcus aureus
  MISC_FEATURE (1)..(530): L-lactate permease
MTLLTVNPFDNVGLSALVAAVPIILFLLCLTVFKMKGIYAALTTLVVTLIVALFVFELPARVSAGAITEGVVAGIFPIGYIVLMAVWLYKVSIKTGQFSIIQDSIASISVDQRIQLLLIGFCFNAFLEGAAGFGVPIAICAVLLIQLGFEPLKAAMLCLIANGAAGAFGAIGLPVSIIDTFNLSGGVTTLDVARYSALTLPILNFIIPFVLVFIVDGMKGIKEILPVILTVSGTYTGLQLLLTIFHGPELADIIPSLATMVVLAFVCRKFKPKNIFRLEASEHKIQKRTPKEIVFAWSPFVILTAFVLVWSAPFFKKLFQPGGALESLVIKLPIPNTVSDLSPKGIALRLDLIGATGTAILLTVIITILITKLKWKSAGALLVEAIKELWLPILTISAILAIAKVMTYGGLTVAIGQGIAKAGAIFPLFSPVLGWIGVFMTGSVVNNNTLFAPIQATVAQQISTSGSLLVAANTAGGVAAKLISPQSIAIATAAVKKVGEESALLKMTLKYSIIFVAFICVWTFILTLIF

SEQ ID NO: 4591 - DNA, 507 bp, Staphylococcus aureus
gtgttatacataaaatgtaaagaaagaggcgatagaatgtctaaaatcaggtcttttacaatattaagtctacttatttacttagctatgatgtgctatacagtagtgacctatccaaaattaccaaccaaagtgcctattcattataatttagcaggggatgctgataattttgctgataaatgggtgctgcttttgattaatagcgcatttatagtgatttggcttatatttttcattgcaggtagatactatgaacgatttgccaaatggtcacattataatcatacaccacgtgaaattcgagcgattaaattatttttaagtacgttaaatttagagattatgagctatatgtctatcttcacagtattagaaatttggcaaatacaacaccatcatcaattcaatttactatggtttaatatgatatttatcattatcattggtttgacgcttgtcatattttgtttacttcctacaattcataaaatgagagattctcaa

SEQ ID NO: 4592 - protein, 169 aa, Staphylococcus aureus
  MISC_FEATURE (1)..(169): hypothetical protein
VLYIKCKERGDRMSKIRSFTILSLLIYLAMMCYTVVTYPKLPTKVPIHYNLAGDADNFADKWVLLLINSAFIVIWLIFFIAGRYYERFAKWSHYNHTPREIRAIKLFLSTLNLEIMSYMSIFTVLEIWQIQHHHQFNLLWFNMIFIIIIGLTLVIFCLLPTIHKMRDSQ

SEQ ID NO: 4593 - DNA, 1437 bp, Staphylococcus aureus
ttgaatggatttacctatccaattttaaaagggagggagaagatggctaaatataaagatattgctagtgacataagagataaaataatcacaggggattggttttatggaatgaaaataccttcacataggcagttggcgatacagtacaacgtaaatagagtaacgattattaaaagtattgagttattagaagctgaaggatttatctatactaaagtaggtagtggaacatatgttaatgactatttgaatgaagcacatattacaaataagtggtctgaaatgatgttatggtcctctcaacaaagaagtcagtatacggtgcaattaattaataaaattgagacagatgattcgtatatacatataagtaaaggtgaattgggtatatcgttaatgccacatattcaattgaaaaaagccatgtctaatacagccagtcatattgaagacttatcttttggttataataatggctatggttatatcaagttaagagatattatcgttgaacgaatgtcaaagcaaggtataaatgtaggtagagaaaatgtaatgatcacttcaggcgctttacatgccattcaacttttatctattgggtttttaggtcaagatgccataataatttcgaatacaccatcatatattcactctacaaatgtttttgagcaattgaattttagacatattgatgttccttataatcaaattaatgaaattgataccatcattgatagatttattaattttaaaaataaagcgatttatatagaacctaggtttaataacccgacaggtcgttctttaacgaatgagcaaaagaaaaatataattacttatagcgaaagacataatattcctatcattgaagatgatatctttagagatattttctttagcgatccaactccttctatcaaaacttatgataaattgggaaaagttatacatataagcagtttttcaaaaacgattgcaccagcaataagaataggttggattgttgcttctgaaaaaataatagagcaattggcagatgtaagaatgcaaattgactatggatccagtattttgtcacaaatggttgtatatgagatgttgaaaaataagtcttatgataaacacttagtaaagttaaggtatgttttaaaagataaacgagactttatgttaaacatcctcaataatttatttaaggatatagcacattgggaggttccaagtggaggttattttgtatggttagtctttaaaatagatatagatattaaatatttattttacgaattgttaagtaaagaaaaaatattaatcaatccgggttacatttatggcagtaaagaaaagagtataaggctatcttttgcctttgaatcaaatgaaaatattaagcatgcgctctataaaatttatacatatgtgaaaaaggtt

SEQ ID NO: 4594 - protein, 479 aa, Staphylococcus aureus
  MISC_FEATURE (1)..(479): hypothetical protein
LNGFTYPILKGREKMAKYKDIASDIRDKIITGDWFYGMKIPSHRQLAIQYNVNRVTIIKSIELLEAEGFIYTKVGSGTYVNDYLNEAHITNKWSEMMLWSSQQRSQYTVQLINKIETDDSYIHISKGELGISLMPHIQLKKAMSNTASHIEDLSFGYNNGYGYIKLRDIIVERMSKQGINVGRENVMITSGALHAIQLLSIGFLGQDAIIISNTPSYIHSTNVFEQLNFRHIDVPYNQINEIDTIIDRFINFKNKAIYIEPRFNNPTGRSLTNEQKKNIITYSERHNIPIIEDDIFRDIFFSDPTPSIKTYDKLGKVIHISSFSKTIAPAIRIGWIVASEKIIEQLADVRMQIDYGSSILSQMVVYEMLKNKSYDKHLVKLRYVLKDKRDFMLNILNNLFKDIAHWEVPSGGYFVWLVFKIDIDIKYLFYELLSKEKILINPGYIYGSKEKSIRLSFAFESNENIKHALYKIYTYVKKV

SEQ ID NO: 4595 - DNA, 105 bp, Staphylococcus aureus
atgatagtaaataaatatgatagaaaagtagtgtctcgaagtttattcattaatatcatcactcctttaattatgtgtttctatattaaaaaatatgatttaaaa

SEQ ID NO: 4596 - protein, 35 aa, Staphylococcus aureus
MIVNKYDRKVVSRSLFINIITPLIMCFYIKKYDLK

SEQ ID NO: 4597 - DNA, 819 bp, Staphylococcus aureus
ttgtggggatctgcatttccaatgataaagattgcgttaaatgattttagtgcagaatcattgtcggcatttcgtttaattttagcaacaataattctcttgccgttcgtaattataaagaaattgcctacccctgaactaagagatatccctgttatttttattttaggattttgtggatttgtgatatatcacacagctttaaattttggtgaaactttgattagtgcaggtatatctggaattctagtctctacaacgcctattttttctagtgctttagcttatatatttttaaaagagcatttttcaaaatggaattggttaagttcactcgtcgcatttataggaatatccattatttcaataagtaaagatgattacacaactattaatgtattaggtgtttttattattttacttgcatcttttagtgaaagtttgtattttactttccagaaaaaatacatagaaaaatacggcttcatcgctttcacactatatacaataatggcaagctcaccatttatgcttatttttattcctgaaatcatcaacgatatacacggcgccacttttacatcaatagtatcggtactttatttagctatattccctactataattccatacgttttgcttgcttatattgtgaagtcagttggtgtctctgatgcaacaatgtctctttatttaacacctatcgtttctttattattatcttatctgttattagacgagctaccaacaacccttgctattataggcggaattatcactctactaggcgttagtttaagtaacttctttcaaaataca

SEQ ID NO: 4598 - protein, 273 aa, Staphylococcus aureus
  MISC_FEATURE (1)..(273): conserved hypothetical
LWGSAFPMIKIALNDFSAESLSAFRLILATIILLPFVIIKKLPTPELRDIPVIFILGFCGFVIYHTALNFGETLISAGISGILVSTTPIFSSALAYIFLKEHFSKWNWLSSLVAFIGISIISISKDDYTTINVLGVFIILLASFSESLYFTFQKKYIEKYGFIAFTLYTIMASSPFMLIFIPEIINDIHGATFTSIVSVLYLAIFPTIIPYVLLAYIVKSVGVSDATMSLYLTPIVSLLLSYLLLDELPTTLAIIGGIITLLGVSLSNFFQNT

SEQ ID NO: 4599 - DNA, 1782 bp, Staphylococcus aureus
ttggtggatatgtattacagttatggaaattatgaagcatttgcgcgccctaaaaaacctgaaaatgtagaaaacaaatccgcttacttaatcggatctggtctagcttcacttgctgcagcttgttttttaataagggatggtcaaatggaaggttcgaagattcatattttagaagagttacctaaagcaggtggtagtcttgatggtgaaaatatgcctttaaaaggctatgttgtccgcggtggtcgtgaaatggagaaccactttgaatgtttgtgggacttattcagatctatcccttcattagaaatcgataacgcgtctgtattagatgagttctattggctaaacaaagaagaccctaactattctcgctgtcgtgttattgagaaacagggtcaacgtttagtcacagacggagacttcactttgactaaaacggcgattaaagaaattttagatttatgcttaacgaatgaagaagatttagatgatgtcaaaataacagatgtattttccgatgacttctttaattcaaacttttggatttactggaaaacgatgtttgcatttgaaccgtggcattctgcaatggaaatgcgtcgctatctaatgcgattcgttcatcatattagtggtctcgcagacttttcagctttaaaattcactaaatataatcaatatgaatctttagtattacctatggttgaatatttaaaatcgcatggggttcaatttgaatacgatgtaaaagtcgaagatattaaaatagatgttacgacaagtcaaaaaattgcccgagaaatattaattgaccgtaatggtaatgcagaatctattaaactgactataaacgatcttgtctttgtgacaaacggtagtattacagaaagctctacttatggtgataatgatacaccagcgccaccaactgacgaattaggtggtagttggacactatggaaaaatttagcgcgacaaagtcctgaatttggtaatcctgataagttttgccaaaatattcctaaaaaaagttggtttgtttcagcaacttctacaacaaacaataaagagattatcgatacaatagaaagtatttgtaaacgtgacccacttgcaggcaaaacagttacaggcggtattattacaatcaatgattctgcatggcaaatgagttttacaatcaatcgtcagcaacagtttaaagaccaacctgaaaatgaaatatctacatggatttatgccttatattcagatgtaaacggcgattatattaaaaagccaattacagaatgtagtggtaatgaaatatgccaagaatggctgtatcacttaggtgtatcaactgacaaaattgaagacttagcaaaacatgcatctaatacgattcctgtttatatgccatatatcacatcttatttcatgacgcgtgctatcggcgacagacctttagtcgtcccgcatcaatctcagaacttagcatttattggtaactttgcagaaacagagcgagacactgtatttacaacagaatattcggttcgtactgccatggaagctgtttatcaattactaaatatagatcgtggtattccagaagtcatcaatagtccatttgatcttcgcgtcttaatggatgccatatacgaactgaatgaccaccaagatttgcgtgagattactaaagattcgaaaatgcaaaaactcgcattagcaggattccttaaaaagataaaaggtacgtacattgagtcattattaaaagaacacaaattgtta

SEQ ID NO: 4600 - protein, 594 aa, Staphylococcus aureus
  MISC_FEATURE (1)..(594): 67 kDa Myosin-crossreactive
LVDMYYSYGNYEAFARPKKPENVENKSAYLIGSGLASLAAACFLIRDGQMEGSKIHILEELPKAGGSLDGENMPLKGYVVRGGREMENHFECLWDLFRSIPSLEIDNASVLDEFYWLNKEDPNYSRCRVIEKQGQRLVTDGDFTLTKTAIKEILDLCLTNEEDLDDVKITDVFSDDFFNSNFWIYWKTMFAFEPWHSAMEMRRYLMRFVHHISGLADFSALKFTKYNQYESLVLPMVEYLKSHGVQFEYDVKVEDIKIDVTTSQKIAREILIDRNGNAESIKLTINDLVFVTNGSITESSTYGDNDTPAPPTDELGGSWTLWKNLARQSPEFGNPDKFCQNIPKKSWFVSATSTTNNKEIIDTIESICKRDPLAGKTVTGGIITINDSAWQMSFTINRQQQFKDQPENEISTWIYALYSDVNGDYIKKPITECSGNEICQEWLYHLGVSTDKIEDLAKHASNTIPVYMPYITSYFMTRAIGDRPLVVPHQSQNLAFIGNFAETERDTVFTTEYSVRTAMEAVYQLLNIDRGIPEVINSPFDLRVLMDAIYELNDHQDLREITKDSKMQKLALAGFLKKIKGTYIESLLKEHKLL

SEQ ID NO: 4601 - DNA, 1665 bp, Staphylococcus aureus
atggaaatgtcggttacagaagtcattttctcctttttaggtggtttaggtattttcctttacggcttaaaaatcatgggagacgggcttcaagcatcagcaggagacaggctacgagatattttaaacaaatttacatcaaatccagtattaggtgttattgcaggtatcgttgtaactattttaatacaaagtagttcaggtacgacagttatcacaatcggactggtaacagctggatttatgacattgaaacaagccattggagtgataatgggtgctaatatcggaacaacggtaactgcatttattatcggtatagatttaggcgaatatgcaatgccaattttagcattaggtgcattcttaatctttttctttaaacgctctaaaatcaataacattggccgcatactattcggtttcggttcactattcttcggtctagaatttatgggtgatgccgttaaacctttagcatcattagatggatttaagcaattaatgcttgatatgtctacaaatccaatactcgctgtcattgtcggcgcagggttaacagcactagttcaaagttcaagtgcgacgattggtattttacaagaattttatcaacaagatttaattagcttaaacgcagcaatccctgtgttactaggcgataacattggtaccacgattacagctatcttagctagtttagccggctcaatcgctgcaaaacgtgcggcgcttgtacacgtcatctttaacttaatcggggtaattatcttcacaattttcttgccagttgtgattcatttgattagtttgttacaagatttatggcacttaaaaccagcgatgacgattgcagtatcacatggtatcttcaacataacaaatactttgattcaattaccatttgtagcaggtttagcatggattgttacaaagcttgtcccaggtaaagatattgctgatgactataaacctcagcacttaaacaaagatcttgtttatcacgcacctggtgttgcattacaagaaactcaaaaagaattacaaaatgtgggtcagattgtcttatcaatgtttgaagacattcgcgaaattacaaaagacgataaaaaattgatcaaaaagcttgaacaaaagcatcaagctgttgaaacaatcaatgatagcattcgaaattatttagttagaatttctacaaaagccattacgaaggcagacgttgagcgtttagcagttatgtttgatgtcaatcgctctattttaaaagtagcagagctaacagaagagtatgtcgctcaattaaaacgccaacatgatgaagatattcgcattacagaagatgcacaacgcggtatggataaattattcaaccatgttgctgagtcatttgataaagccatcgacatgttagatgtttatgacaaaacgaaaaaagatgaaattgtagaacgtagtagagaatcatttaatattgaacataaactacgcaaaggtcatattaaacgccttaatcgtggtgaatgtacaacaaaaggcggattactatatatcgatatgattggtgttcttgaacgtatcggttatcattcacgaaatgtttctgaagcacttgttggccttaacgatgatgtacctacagatgaagaaattgcaacaactgaaatt

SEQ ID NO: 4602 - protein, 555 aa, Staphylococcus aureus
  MISC_FEATURE (1)..(555): conserved hypothetical
MEMSVTEVIFSFLGGLGIFLYGLKIMGDGLQASAGDRLRDILNKFTSNPVLGVIAGIVVTILIQSSSGTTVITIGLVTAGFMTLKQAIGVIMGANIGTTVTAFIIGIDLGEYAMPILALGAFLIFFFKRSKINNIGRILFGFGSLFFGLEFMGDAVKPLASLDGFKQLMLDMSTNPILAVIVGAGLTALVQSSSATIGILQEFYQQDLISLNAAIPVLLGDNIGTTITAILASLAGSIAAKRAALVHVIFNLIGVIIFTIFLPVVIHLISLLQDLWHLKPAMTIAVSHGIFNITNTLIQLPFVAGLAWIVTKLVPGKDIADDYKPQHLNKDLVYHAPGVALQETQKELQNVGQIVLSMFEDIREITKDDKKLIKKLEQKHQAVETINDSIRNYLVRISTKAITKADVERLAVMFDVNRSILKVAELTEEYVAQLKRQHDEDIRITEDAQRGMDKLFNHVAESFDKAIDMLDVYDKTKKDEIVERSRESFNIEHKLRKGHIKRLNRGECTTKGGLLYIDMIGVLERIGYHSRNVSEALVGLNDDVPTDEEIATTEI

SEQ ID NO: 4603 - DNA, 1386 bp, Staphylococcus aureus
atgaatgaaacgtatcgcgggggcaacaagttaatcttaggtattgtattaggtgttattacattttggttgtttgcacaatcacttgtaaatgttgtaccgaatttacaacaaagttttggtacagacatggggacaattagtattgcggtcagtctaactgcactattttcaggcatgtttgttgttggagcaggtggtctggcagataaaattgggcgcgtgaaaatgacgaatatcggtttattattaagtattattggttcagcattaattattattacgaatttaccggcattattaattttaggtcgtgttatacaaggtgtatcagcagcgtgtattatgccttctacattggccattatgaaaacttattatcagggtgctgaacgtcagcgtgccttaagttattggtctatcggttcttggggtggcagtggtatctgttcactcttcggtggtgcagttgcgacaactatgggttggagatggattttcatcttctcaattatcgttgccgtactttcaatgttactcatcaaagggacgcctgaaacgaaatcagaaattaccaatacacataaatttgacgttgcagggctaattgttctagtagttatgttgctaagtttaaacgttgtcattactaaaggtgcagcacttggttacacatcattatggttctttggtttgattgcaatcgtaattgtagcattctttattttcttaaatgttgagaaaaaagtagataatccacttattgattttaaattatttgaaaataaaccatatacaggtgcaacgatttcgaacttcttattaaacggttttgcaggtacattaattgtagcgaatacattcgtgcaacaaggtttaggttatacagcattgcaggcaggatacttatcaattacttatttaatcatggtgttattgatgattcgagttggtgaaaaattattacaaaaaatgggttctaagcgaccaatgttattaggtacattcattgtggtcattggtattgcacttatttcattagtattcttaccaggcatattttatgttatcagttgtgtcgtaggatatttatgtttcggactaggcttaggtatttatgcaacaccttctacagatacagctatttcgaatgcaccgttagataaagttggcgttgcttcaggtatttataaaatggcttcatcacttggtggcgcattcggtgtcgcaattagtggtgctgtatatgctggtgcagttgctgcaacgagcattcatacaggtgcgatgattgcactttgggttaacgtattaatgggaatcatggcatttatcgcaattttattcgcgattcctaatgatgataaacgtgtcaaagatgcgaaa

SEQ ID NO: 4604 - protein, 462 aa, Staphylococcus aureus
  MISC_FEATURE (1)..(462): hypothetical protein
MNETYRGGNKLILGIVLGVITFWLFAQSLVNVVPNLQQSFGTDMGTISIAVSLTALFSGMFVVGAGGLADKIGRVKMTNIGLLLSIIGSALIIITNLPALLILGRVIQGVSAACIMPSTLAIMKTYYQGAERQRALSYWSIGSWGGSGICSLFGGAVATTMGWRWIFIFSIIVAVLSMLLIKGTPETKSEITNTHKFDVAGLIVLVVMLLSLNVVITKGAALGYTSLWFFGLIAIVIVAFFIFLNVEKKVDNPLIDFKLFENKPYTGATISNFLLNGFAGTLIVANTFVQQGLGYTALQAGYLSITYLIMVLLMIRVGEKLLQKMGSKRPMLLGTFIVVIGIALISLVFLPGIFYVISCVVGYLCFGLGLGIYATPSTDTAISNAPLDKVGVASGIYKMASSLGGAFGVAISGAVYAGAVAATSIHTGAMIALWVNVLMGIMAFIAILFAIPNDDKRVKDAK

SEQ ID NO: 4605 - DNA, 1185 bp, Staphylococcus aureus
atgaaggatatgaatcaacaattaattgaaactttaaaatctaaagaaggcaaaatgattgagatcagacgttatttacatcagcatccagaattatcttttcatgaagatgaaacggcgaaatacatcgctgaattttacaaaggtaaagatgtggaagtagaaacgaatgtcggaccacgtggaattaaagtaacgattgattcagggaaacctggtaaaacattagcaatccgtgcagactttgacgcattacccattactgaagatacaggattatcttttgcatcacaaaataaaggtgttatgcacgcatgtggtcacgatgcacatacagcatacatgcttgtattagcagagacgcttgctgaaatgaaagatagttttacaggaaaagtcgttgtgatacatcaaccagctgaagaagtaccaccaggtggtgctaaaacaatgattgaaaatggtgtattagacggtgttgatcatgtattaggtgtacacgtcatgagcacaatgaaaacaggtaaagtgtattacagacctggttatgttcaaacaggacgcgcattcttcaaattgaaagttcaaggtaaaggtggtcatggttcatcaccacatatggccaatgatgccattgttgcaggtagctacttcgtcacagcgttacaaacagttgtatctagacgactaagtccatttgaaaccggtgttgtcacaatcggttcatttgacggtaaaggtcaattcaatgtcattaaagatgttgttgaaattgaaggtgatgtacgtggattaacagatgctacaaaagcaacaattgaaaaagaaattaaacgtttatcaaaaggattagaggatatgtatggtgtaacttgcaccttagaatataacgatgattatccagcattatataatgatccagagtttactgagtacgtggctaagacgttgaaagaagcaaaccttgattttggtgttgaaatgtgtgaaccacaaccaccttcagaagactttgcatattatgctaaagaacgcccaagtgcctttatttatacaggtgcagcggtggaaaatggtgaaatttacccacatcatcatcctaaatttaacatttcagaaaaatcattacttatttctgcagaagcagtagggacagttgttttagattaccttaaaggagataac

SEQ ID NO: 4606 - protein, 395 aa, Staphylococcus aureus
  MISC_FEATURE (1)..(395): hypothetical protein
MKDMNQQLIETLKSKEGKMIEIRRYLHQHPELSFHEDETAKYIAEFYKGKDVEVETNVGPRGIKVTIDSGKPGKTLAIRADFDALPITEDTGLSFASQNKGVMHACGHDAHTAYMLVLAETLAEMKDSFTGKVVVIHQPAEEVPPGGAKTMIENGVLDGVDHVLGVHVMSTMKTGKVYYRPGYVQTGRAFFKLKVQGKGGHGSSPHMANDAIVAGSYFVTALQTVVSRRLSPFETGVVTIGSFDGKGQFNVIKDVVEIEGDVRGLTDATKATIEKEIKRLSKGLEDMYGVTCTLEYNDDYPALYNDPEFTEYVAKTLKEANLDFGVEMCEPQPPSEDFAYYAKERPSAFIYTGAAVENGEIYPHHHPKFNISEKSLLISAEAVGTVVLDYLKGDN

SEQ ID NO: 4607 - DNA, 156 bp, Staphylococcus aureus
ttgattatgtctaaagacaaagatccaaaattaaattatcatgaagaagaaaacagtatggtaacggattttgaagatttaaaagaattaggtaaagaaatggaacaaatctctgatcaaaatgatcaagaaaagaattctgaagaagacagtcag

SEQ ID NO: 4608 - protein, 52 aa, Staphylococcus aureus
  MISC_FEATURE (1)..(52): hypothetical protein
LIMSKDKDPKLNYHEEENSMVTDFEDLKELGKEMEQISDQNDQEKNSEEDSQ

SEQ ID NO: 4609 - DNA, 2235 bp, Staphylococcus aureus
atgcaacgtgattatttaattcgagtagaaactgagagtatgtcagatttcaaaaggctcaatagtttaatgattggttttgttattaaaggtgaggcacacatttatgatgaaaataatatgacgcaatgcaacagtggcgacattttcatcattaaccaccgcgacttgtatcgatttcaacttcaacaagatggcatcatatgttatatccaattccaaatgaaatatttagcagacaagtttgatgatgtgcattgtctatattttcacttaacagatgcgaccacaacaaagaatatacatcaactgagaaatataatggcaagactggtttcaacacatatccgacataatgagttgtctaaattgactgagcaacaacttgtgattcagttgcttatgcatatgattcattatgtcccgcgtacatatcattcgaaccaaagtatcttaaatgatgataaagtgaatcaagtatgcgactatatcgagttacattttcatgaagatttaagcctttcagaattaagcgaatacgttgggtggtcagagagccatctgtctaaaaagtttacagaatcgctaggtgtaggattccatcatttcttaaatacgacgcgaattgagcatgcgaaactcgatttgacatacacagatgaaaccattactgatattgcattgcaaaatggcttttcaagtgcagcgagctttgcgagaacatttaaacactttacgcatcaaacacctaaacaatatcgaggtgatcgtccagcaatcactgaaaaccagcaatcggcacaacatgattatcacgaccgtgaattgatattacttttaaatgactacattgaagaaatgaatcattttattgaagatattgaaaagatgaactataaagagattgcctttcaaccaaccaatcaccaactaaatcaatttaatcatattattcaagtgggctatttgaggaatttgctcaatacacagtatcaatcacagttgcttacatgtcatcatgattttcaagtcaatgaagtattagcatatgatgtgattccatatatcatgaaaaagctcaatgcgccattcacgtatgatgcagaaatttcgaatatattttatgatattgatttgtgtttagactttttattagatcataactttagtttgaccatgcatttggatcagtatgactcacgtgattatatcgatgcatttaaaatttttatccatcacgttgccctgcatgtcagtcatagaaaagatttgaagttcaacttgtatgtgacgacattgcacacgtctttgattgaaatgattgattattttaaagcattattccctaatggtggcttgtacattcacttagatcaagctacggaaagacatctaccattattgaaacgacttgagccacacatcgaccattttgtatttgatgccaattcaaatgacgctgttgattttaataaaatgaatgatgatgaatttaaaaccgcgagtcaaatgattattaataaaacgaattaccttatcgacttaatgcatcgtcatcgcctaaagcgtccactcattttactcaattggaatacattgacgggtgatacatttattacaaacggcgaatattttagaggtggtatcatcattgagcaattattaaaattaagttctaaagtagagggtatcgggtattggttgaattatgatttgcacgtcagtcattgtaaaaatgaacgggattatatgaattctattgaactatttcatcaatataatggaaaacgtccggtctatttcacggcattgctatttaataaattaacaagcaatattttgtattctgatgatacatgtattgtcacggggactgattcaaattttcaaatattgttatatgatgcaaagcattttaatccgtacttagcgttggacaatcaaatgaatatgcgtgcgacggaaatgattcatttgaacattaatgccctggaagaaggtatgtataagattaaacattttaccttagataaagaaaatggtgcgttatttaatctttggcgcaaacatcatacgatacatggcatggacaaggactctatagattacgttaatcgaatgagttttccgaaattagaagtatatgatatagatatcacggacacactggcattaaacattaaaatgattacgaatgggattcacttaattgaagtaaaacgttacccaagttca

SEQ ID NO: 4610 - protein, 745 aa, Staphylococcus aureus
  MISC_FEATURE (1)..(745): hypothetical protein
MQRDYLIRVETESMSDFKRLNSLMIGFVIKGEAHIYDENNMTQCNSGDIFIINHRDLYRFQLQQDGIICYIQFQMKYLADKFDDVHCLYFHLTDATTTKNIHQLRNIMARLVSTHIRHNELSKLTEQQLVIQLLMHMIHYVPRTYHSNQSILNDDKVNQVCDYIELHFHEDLSLSELSEYVGWSESHLSKKFTESLGVGFHHFLNTTRIEHAKLDLTYTDETITDIALQNGFSSAASFARTFKHFTHQTPKQYRGDRPAITENQQSAQHDYHDRELILLLNDYIEEMNHFIEDIEKMNYKEIAFQPTNHQLNQFNHIIQVGYLRNLLNTQYQSQLLTCHHDFQVNEVLAYDVIPYIMKKLNAPFTYDAEISNIFYDIDLCLDFLLDHNFSLTMHLDQYDSRDYIDAFKIFIHHVALHVSHRKDLKFNLYVTTLHTSLIEMIDYFKALFPNGGLYIHLDQATERHLPLLKRLEPHIDHFVFDANSNDAVDFNKMNDDEFKTASQMIINKTNYLIDLMHRHRLKRPLILLNWNTLTGDTFITNGEYFRGGIIIEQLLKLSSKVEGIGYWLNYDLHVSHCKNERDYMNSIELFHQYNGKRPVYFTALLFNKLTSNILYSDDTCIVTGTDSNFQILLYDAKHFNPYLALDNQMNMRATEMIHLNINALEEGMYKIKHFTLDKENGALFNLWRKHHTIHGMDKDSIDYVNRMSFPKLEVYDIDITDTLALNIKMITNGIHLIEVKRYPSS

SEQ ID NO: 4611 - DNA, 765 bp, Staphylococcus aureus
atgaaacgattaaacaaattggtattgtatattagttttttgatattagtcattagtttcactgctggttgtggcataggtaaagaagcggaagttaagaaaagctttgaaaaaacattgagtatgtatccgattaaaaatctagaggatttatacgataaagaaggttatcgtgatgacgaatttgataaaaatgataaaggtacatggattattggttctgaaatggttgttcaacctaaaggggaacgtatgaaatcaaaaggtatggttctatatatgaatagaaacactaagactacaaccgggaagtatatagtgagtgaaacacttcatgatgaagatggtagacctaagagtaaagataaagaatatcccgttaaaatggtagacaataaaatcattccaactaaaggtatcaaagacgaaaatataaaaaaagaaatcgagaattttaagttcttcgcgcaatatggcagctttaaagatttgtcgaagtacaaagacggcgatatatcatataatccagaggtaccgagttattcagcaaaatatcaattaactaatgatgactataatgtaaaacaattacgaaaaagatataaaataccaacgaataaagcaccaaagttattgttgaaaggttcgggagacttaaaaggttcatcagttggatataaagacattgaatttacttttgtggagaaaaaaggtgaaaatactttttttactgatagtctacatcttgaaccgagtgaggataaa

SEQ ID NO: 4612 - protein, 255 aa, Staphylococcus aureus
  MISC_FEATURE (1)..(255): hypothetical protein
MKRLNKLVLYISFLILVISFTAGCGIGKEAEVKKSFEKTLSMYPIKNLEDLYDKEGYRDDEFDKNDKGTWIIGSEMVVQPKGERMKSKGMVLYMNRNTKTTTGKYIVSETLHDEDGRPKSKDKEYPVKMVDNKIIPTKGIKDENIKKEIENFKFFAQYGSFKDLSKYKDGDISYNPEVPSYSAKYQLTNDDYNVKQLRKRYKIPTNKAPKLLLKGSGDLKGSSVGYKDIEFTFVEKKGENTFFTDSLHLEPSEDK

SEQ ID NO: 4613 - DNA, 768 bp, Staphylococcus aureus
atgatgaaacgattaaacaaattagtgttaggcattatttttctgtttttagtcattagtatcactgctggttgtggcataggtaaagaagcgaaaataaagaaaagttttgagaagacattgagtatgtatccgattaaaaatctagaggatttatacgataaagaaggttatcgtgatgacgaatttgataaaaatgataaaggtacatggattattggttctgaaatggcaactcaaaataagggggaagctctgaaagttaaaggtatggtcttgtatatgaatagaaataccaaaacaacaaaaggatattattatgtaaatgcaataaagaatgataaagacggaagaccccaagagaatgaaaaaaggtacccagttaaaatggtcgataataaaatcattccaacaaaagaaattaaagataaaaacataaaaaaagaaatcgaaaactttaagttctttgttcaatatggaaactttaaagatttgtcgaagtataaagacggagatatttcatataatccagaggtgccgagttattcggctaaatatcaattaactaatgatgattacaatgtaaagcaattacgtaaaagatatgacataccaacaaataaagcaccgaagttgttgttgaagggtacagggaatttaaaaggttcatcagttggatataaagacattgaatttacgtttgtagagaaaaaagaagagaacatttactttagtgatgggttaatttttaaaccaagtgaggataaa

SEQ ID NO: 4614 - protein, 256 aa, Staphylococcus aureus
  MISC_FEATURE (1)..(256): hypothetical protein
MMKRLNKLVLGIIFLFLVISITAGCGIGKEAKIKKSFEKTLSMYPIKNLEDLYDKEGYRDDEFDKNDKGTWIIGSEMATQNKGEALKVKGMVLYMNRNTKTTKGYYYVNAIKNDKDGRPQENEKRYPVKMVDNKIIPTKEIKDKNIKKEIENFKFFVQYGNFKDLSKYKDGDISYNPEVPSYSAKYQLTNDDYNVKQLRKRYDIPTNKAPKLLLKGTGNLKGSSVGYKDIEFTFVEKKEENIYFSDGLIFKPSEDK

SEQ ID NO: 4615 - DNA, 801 bp, Staphylococcus aureus
atgaaatcaatcccggaaaaagagagtgatgaaatgataaaacgtgtaaataaattagtgcttggtattagtcttctgtttttagtcattagtatcactgctggttgtggcatgggtaaagaagcggaaataaagaaaagttttgaaaaaacattgagtatgtatccgattaaaaatctagaggatttatacgataaagaaggatatcgtgatgatcaatttgataaaaatgataagggaacatggattgtaaattctcaaatggcaattcaaaataaaggagaagctctaaaaataaaaggcatgcttttgaagatagatagaaatacaagaagtgcaaaaggattttactatactaatgaaataaagacggagaaatacgaagtagctcaggataatcaaaaaaaatatccagttaaaatgattaataataaattcatttctactgaggaagttaaagaagaaaacataaaaaaagaaatcgaaaactttaagttttttgcgcaatatagcaattttaaagatttaatgaattataaagatggagatatatcatataatccagaggtgccgagttattcagctcaatatcaattaactaatgatgattataatgtaaaacaattacgtaaaagatatgacataccaacaaataaagcgccgaagctgttgttgaaaggtacagggaatttaaaaggttcatcagttggatataaaaaaattgaatttacttttttagagaataaaaatgaaaatatttactttactgatagtctacatcttgaaccgagcgaggataaa

SEQ ID NO: 4616 - protein, 267 aa, Staphylococcus aureus
  MISC_FEATURE (1)..(267): hypothetical protein
MKSIPEKESDEMIKRVNKLVLGISLLFLVISITAGCGMGKEAEIKKSFEKTLSMYPIKNLEDLYDKEGYRDDQFDKNDKGTWIVNSQMAIQNKGEALKIKGMLLKIDRNTRSAKGFYYTNEIKTEKYEVAQDNQKKYPVKMINNKFISTEEVKEENIKKEIENFKFFAQYSNFKDLMNYKDGDISYNPEVPSYSAQYQLTNDDYNVKQLRKRYDIPTNKAPKLLLKGTGNLKGSSVGYKKIEFTFLENKNENIYFTDSLHLEPSEDK

SEQ ID NO: 4617 - DNA, 768 bp, Staphylococcus aureus
atgatgaaacgattaaacaaattagtgttaggcattatttttctgtttttagtcattagtatcactgctggttgtggcataggtaaagaagcggaagttaagaaaagctttgaaaaaacattgagtatgtaccctattaaaaatctagaggatttatacgataaggaaggctatcgtgatgatcagtttgataaaaatgataaaggtacatggattataaattctgaaatggttattcaacctaataatgaagatatggtagctaaaggcatggttctatatatgaatagaaataccaaaacaacaaatggttactactatgtcgatgtgactaaggacgaggatgaaggaaaaccgcacgacaatgaaaaaagatatccggttaaaatggtcgataataaaatcattccaacaaaagaaattaaagatgaaaaaataaaaaaagaaatcgaaaactttaagttctttgttcaatatggcgactttaaaaatttgaaaaattataaagacggagatatttcatataatccagaggtgccgagttattcggctaaatatcaattaactaatgatgattataatgtaaaacaattacgcaaaagatatgatataccgacgagtaaagctccaaagttattgttaaaaggttcagggaatttaaaaggctcatcagttggatataaagatattgaatttacgtttgtagagaaaaaagaagaaaatatatactttagtgatagcttagattataaaaaaagcggagatgta

SEQ ID NO: 4618 - protein, 256 aa, Staphylococcus aureus
  MISC_FEATURE (1)..(256): hypothetical protein
MMKRLNKLVLGIIFLFLVISITAGCGIGKEAEVKKSFEKTLSMYPIKNLEDLYDKEGYRDDQFDKNDKGTWIINSEMVIQPNNEDMVAKGMVLYMNRNTKTTNGYYYVDVTKDEDEGKPHDNEKRYPVKMVDNKIIPTKEIKDEKIKKEIENFKFFVQYGDFKNLKNYKDGDISYNPEVPSYSAKYQLTNDDYNVKQLRKRYDIPTSKAPKLLLKGSGNLKGSSVGYKDIEFTFVEKKEENIYFSDSLDYKKSGDV

SEQ ID NO: 4619 - DNA, 984 bp, Staphylococcus aureus
atgaaaaagtgtattaagactttgtttttaagtatcattttagtagtgatgagtggttggtatcattcagcacatgcgtcagattcgttgagtaaaagtccagaaaattggatgagtaaacttgatgatggaaaacatttaactgagattaatataccgggttcacatgatagtggctcattcactttaaaggatccagtaaaatcagtttgggcaaagactcaagataaagattaccttacccaaatgaagtcgggagtcaggttttttgatattagaggtagagcaagtgctgataatatgatttcagttcatcacggcatggtttatttgcatcatgaattaggaaaatttctcgatgatgctaaatattacttgagtgcttatccaaacgaaacaattgtgatgtctatgaaaaaggactacgatagcgattctaaagttacgaagacatttgaagaaatttttagagaatattattataataacccgcaatatcagaatcttttttacacaggaagtaatgcgaatcctactttaaaagaaacgaaaggtaaaattgtcctattcaatagaatggggggtacgtacataaaaagtggttatggtgctgacacgtcaggtattcaatgggcagacaatgcgacatttgaaacgaaaattaataatggtagcttaaatttaaaagtacaagatgagtataaagattactatgataaaaaagttgaagctgttaaaaatttattggctaaagctaaaacggatagtaacaaagacaatgtatatgtgaatttcttgagtgtagcgtctggaggcagcgcatttaatagtacttataactatgcatcacatataaatcctgaaattgcaaaaacgattaaagcaaatgggaaagctagaacgggttggctgattgttgactatgcaggatatacgtggcctggatatgatgatatcgtaagtgaaattatagatagtaataaa

SEQ ID NO: 4620 - protein, 328 aa, Staphylococcus aureus
  MISC_FEATURE (1)..(328): 1-phosphatidylinositol
MKKCIKTLFLSIILVVMSGWYHSAHASDSLSKSPENWMSKLDDGKHLTEINIPGSHDSGSFTLKDPVKSVWAKTQDKDYLTQMKSGVRFFDIRGRASADNMISVHHGMVYLHHELGKFLDDAKYYLSAYPNETIVMSMKKDYDSDSKVTKTFEEIFREYYYNNPQYQNLFYTGSNANPTLKETKGKIVLFNRMGGTYIKSGYGADTSGIQWADNATFETKINNGSLNLKVQDEYKDYYDKKVEAVKNLLAKAKTDSNKDNVYVNFLSVASGGSAFNSTYNYASHINPEIAKTIKANGKARTGWLIVDYAGYTWPGYDDIVSEIIDSNK

SEQ ID NO: 4621 - DNA, 480 bp, Staphylococcus aureus
atggagaaatttaacaactggatattaaatgcaataagtggatctcaaacagacaagaatgaaacaactgaagaattaaaaggggcaaaatttatcattttatatgcatattcaatgctcgttttgcttgcgttagtaatttctaacatattcattcacattttggagcctaaactatcaatcaccactcaaatcatcatcgttttgattttaattgaagcactaattggactgcgtttcttgaaagcgtacgatgttaagcgtggcaaagataaagaaaataagaaaaatagtaaggatttcgttaaactaaaatcaattttagtagcaattttatttacatcattggcgctgacagcaggtactgtagctgatatatacggtttcactgacttaggaaatactagaagtgatttaatcgtttggagcataggtggtattatatttggcctcgtatgttacacaatggaagataaaaga

SEQ ID NO: 4622 - protein, 160 aa, Staphylococcus aureus
  MISC_FEATURE (1)..(160): hypothetical protein
MEKFNNWILNAISGSQTDKNETTEELKGAKFIILYAYSMLVLLALVISNIFIHILEPKLSITTQIIIVLILIEALIGLRFLKAYDVKRGKDKENKKNSKDFVKLKSILVAILFTSLALTAGTVADIYGFTDLGNTRSDLIVWSIGGIIFGLVCYTMEDKR

SEQ ID NO: 4623 - DNA, 3150 bp, Staphylococcus aureus
atgagtcaattgctaaatgatacgttatcggcttggttgttaattgaatctttaagtccaggagaagtaaattttacagcggaagatatactctcagctgaacattttaaaaatggtgcaaagcaagcacaacttcaaagttttgatgaatattttgaaatatggaatgctgaacgctttattatatcagaagaaaaatcagagactggggaacttatatttaaattttatagacattgcttccgctataatgaaattaatttgaaaattcaggatatttttgatgattattctgagattcataatccaaatgggacacactgttatggttacacatttaacacagataaacacggcaaagtgatagttgattctatacatattccgatgattatgagtgcattaaaagaaattgaaaagaacaaaaatgccaatatagaagaaaaatttaatgattctgttgaaaaatttgttcaaaaagtaaaagaaattttagcagatgaaccaattaatgaatttaaattgaagaagatggacaaagcttatgatgagtacttttctgtattaaattcaaagaaagatggattatttggacattatgtagcaatagaatatgtgaaagatagtgatttaccacagccggaatttaacagcttcttcataagtgatattgagaaagcaagaaaatctcccaaccaaactttaattgattacattgaaggtgtagaagaaagtcagcgcatagaagtagatgaaaataaagaaatgtttgacaaatttttacatccttcacgtttgcctgatggacgatggccatcacagactgagtttagattgtctttaatgcaacaacttgctgtaaaccaaattacgagtggtaatgaaagaataagttcagttaatgggccaccaggtacaggtaagactactttattaaaagatatatttgctcatctagtagttgaaagaggtaaagagttagctaaactaaataatcctaaagatgcatttgtcaaaacaaaaattcatgaaacggatgataaatacgtatacttactaaaggaatctattgccaaatataagatggtagtcgcatctagtaataatggagctgttgaaaatatatctaaagatttaccgaaaattgaagaaattataagaaatcccgaaaaatgtaaattccctaaatatgaacagaattatgcaaatttagcacatgaattaaaagattttgctgaaatagctgaagatttgattggtgaaagtgcctggggcttattttctggagtttttggtaaaagtactaatattaaccaagtattgagtcatatgttaaaacaagatgcgaatgatattggctttgctaaattactacaaaatgagaataatcgtatgagttataacgagttaatgagtgaatggcaatcacatcaacgtgcatttttagaagagttgaggcatgttgaaatgttaaaagaagaatctattagagcatatgatgtttataaaaattgtgagtctttctctaagattgaacaggttattaatagtgaaaaaacaagtattgaagaacaggtatatcatttagataatgaaacgttacgagacaataaagaaatagaagatttggataatcgaattaattatattgttaagcaaatagaaactttaaatgagttaattaaatccatcaaagaaagcaacaaaggttttattaacaaactgaaagcgatgtttaattcagaagaagatgaaagctataaagatcataataaagagaagcaacaattattaacacaacagttagagttagagaaatgtaaaaaaaacaaacatgaagaccttgttagcaaactaaaagaaaaagagaaattaattaaacaattaactaaagtacagttgcaattagacgagttaaattcacagttacaagagttagaagcatatcgtattgagtcaaaaattacaattccagaaaaagatttttggagtgacaacaattatgatgagcgccaagttactaatctgtggacgagtgacgaacttcaatacagacgtgccatgctctttttaagagcaatgatattgcataaattattattgattgctaataatacaactatttattatgcgattaatgattttaaagatagaaggaaattaattgatgcaaatccagataaagtacacaacgcatggaatgtgatgcatttaatatttccagtagttagtacgacgtttgcaagctttaaatctatgtatgggggcataccaaaagatttcatagactacttatttattgatgaagcaggacaagcaatacctcaagcagctgtgggagcattatatcgttcaaaaaaagttgtagctgtaggtgatccgattcaaatagaaccggttgtgactttagaaagtcatttaattgataacattcgtaaaaattatcatgttccggaatatctagtttctaaagaagcttctgtgcagtctgttgcagacaacgccaatcaatatggtttttggaaatctgatgctactgatagtaatcaaaaaacctggataggcatacctttatgggtgcacagacgatgtttaaaacctatgttcacgatagctaaccaaatcgcttataataataaaatggtgttgccaagtaatattacaaaagtaggtaaaacaggttggtatgacgttaaaggaaacgcagttcaaaaacaatttgtgaaagagcatggtgaaaaagtagtgggattattagctgatgattggattgaagcaattaaggaaggtaaaaatgaaccgagctcatttgtaatatcgcctttttcagcagtacagcaacagattaaacgtatgttaaagcaacaactaccgactagaattgatattgaacgtacaaaaattaatcaatgggtcgataaatccattggtactgttcatacttttcaaggtaaagaggctcagaaggtgtattttgtaataggtactgataatacccaagatggtgctgtgaactggtcatgcgaaaaaccaaacttgttaaacgttgcagtgacaagagctaagaaagagttttatgtaattggcgacatgcaaagaatacagatgaaaccattttatgagacgatttttaaagaaagaaatgtaaaa

SEQ ID NO: 4624 - protein, 1050 aa, Staphylococcus aureus
  MISC_FEATURE (1)..(1050): hypothetical protein
MSQLLNDTLSAWLLIESLSPGEVNFTAEDILSAEHFKNGAKQAQLQSFDEYFEIWNAERFIISEEKSETGELIFKFYRHCFRYNEINLKIQDIFDDYSEIHNPNGTHCYGYTFNTDKHGKVIVDSIHIPMIMSALKEIEKNKNANIEEKFNDSVEKFVQKVKEILADEPINEFKLKKMDKAYDEYFSVLNSKKDGLFGHYVAIEYVKDSDLPQPEFNSFFISDIEKARKSPNQTLIDYIEGVEESQRIEVDENKEMFDKFLHPSRLPDGRWPSQTEFRLSLMQQLAVNQITSGNERISSVNGPPGTGKTTLLKDIFAHLVVERGKELAKLNNPKDAFVKTKIHETDDKYVYLLKESIAKYKMVVASSNNGAVENISKDLPKIEEIIRNPEKCKFPKYEQNYANLAHELKDFAEIAEDLIGESAWGLFSGVFGKSTNINQVLSHMLKQDANDIGFAKLLQNENNRMSYNELMSEWQSHQRAFLEELRHVEMLKEESIRAYDVYKNCESFSKIEQVINSEKTSIEEQVYHLDNETLRDNKEIEDLDNRINYIVKQIETLNELIKSIKESNKGFINKLKAMFNSEEDESYKDHNKEKQQLLTQQLELEKCKKNKHEDLVSKLKEKEKLIKQLTKVQLQLDELNSQLQELEAYRIESKITIPEKDFWSDNNYDERQVTNLWTSDELQYRRAMLFLRAMILHKLLLIANNTTIYYAINDFKDRRKLIDANPDKVHNAWNVMHLIFPVVSTTFASFKSMYGGIPKDFIDYLFIDEAGQAIPQAAVGALYRSKKVVAVGDPIQIEPVVTLESHLIDNIRKNYHVPEYLVSKEASVQSVADNANQYGFWKSDATDSNQKTWIGIPLWVHRRCLKPMFTIANQIAYNNKMVLPSNITKVGKTGWYDVKGNAVQKQFVKEHGEKVVGLLADDWIEAIKEGKNEPSSFVISPFSAVQQQIKRMLKQQLPTRIDIERTKINQWVDKSIGTVHTFQGKEAQKVYFVIGTDNTQDGAVNWSCEKPNLLNVAVTRAKKEFYVIGDMQRIQMKPFYETIFKERNVK

SEQ ID NO: 4625 - DNA, 633 bp, Staphylococcus aureus
ttgtttgaaaatagaggtgagcaggtgaacgatatgttaattagtcttgtaatcccagtttttgctttgttagttattggtggtattatttggatgattatagaaggtatagtacatatttcaaaaaagaataaagcaattgataacttttttaaccaagttaataaagtaagtgagacatataaattcgctactacttttttatttctaatcttggctacggctggtatttctcaattttatctatattatatagtatcagcgtttcttttttggcttgtcatacttacctttggcattgcaggtatcatttttttaatgccatatggattatgttttctaccgttttataagcaaaaaaagaaaaaacagacatttaaaaaatacatggtttacactacgattggtttgtcaatttgtctaggcttatctctagttttggttcacactacgaaaatttatatggacgaaggtggcgtaagatactattacggtagttttgtaatgaaacaagcgggcggttatgcttatttagctttagcggtactttcaacgttgttaattgttgcgaaaaaagctacaaataaaaataaagaaatcgaaaccgtcgacaatacaaatataacggaaaga

SEQ ID NO: 4626 - protein, 211 aa, Staphylococcus aureus
  MISC_FEATURE (1)..(211): hypothetical protein
LFENRGEQVNDMLISLVIPVFALLVIGGIIWMIIEGIVHISKKNKAIDNFFNQVNKVSETYKFATTFLFLILATAGISQFYLYYIVSAFLFWLVILTFGIAGIIFLMPYGLCFLPFYKQKKKKQTFKKYMVYTTIGLSICLGLSLVLVHTTKIYMDEGGVRYYYGSFVMKQAGGYAYLALAVLSTLLIVAKKATNKNKEIETVDNTNITER

SEQ ID NO: 4627 - DNA, 741 bp, Staphylococcus aureus
gtgattaaattgaactttaatgatttggaaatttttataactgtatgtgaagaagcatctatcaataaagctgcaattaaacttagatatgcacaatctaatatatctcaaagaattagcaagcttgaaaatgaattaggtgtagttttgctttttagaaatcaaaaaggtgctaaggcaactaaagcaggcgaagaattcttagcgtatagcaaaaaagtattaagagatacagagactataaaaaataaaatgaaaaataatactatgtctattttatgctcagaactgttatttaattatttatctgagagcgaagaaattatgatgtcgaataactcaattaattttatttctagtggaaatattagaaaagctatagaaaaaaataattatgataaggttatttcattcataaaaattaacgactcaaattatagacttagtaatgttgatactatgaaagtaacgctttacagtaatggaagtaattatgataaagaggctttactaataaataaagatgagttttgtcctttaaggaaaataactttagataataagcttgattcacaacgggtaatggaaattgattcattggcagcaataataaacttagttaaacaaggaaaaggaaaggctttattacctatgacttttgagaataaaagagatatagtacaggacatttctaagatatttgaagttaactactatacttataatcatattatgcatcat

SEQ ID NO: 4628 - protein, 247 aa, Staphylococcus aureus
VIKLNFNDLEIFITVCEEASINKAAIKLRYAQSNISQRISKLENELGVVLLFRNQKGAKATKAGEEFLAYSKKVLRDTETIKNKMKNNTMSILCSELLFNYLSESEEIMMSNNSINFISSGNIRKAIEKNNYDKVISFIKINDSNYRLSNVDTMKVTLYSNGSNYDKEALLINKDEFCPLRKITLDNKLDSQRVMEIDSLAAIINLVKQGKGKALLPMTFENKRDIVQDISKIFEVNYYTYNHIMHH

SEQ ID NO: 4629 - DNA, 624 bp, Staphylococcus aureus
atgcaaactaagaggagtgtagaaatcatggcaatgaactttaaagtctttgacaatagtcaacttgtagcagaatatgctgctgatattattagaaagcaatttaacaataatcctactacaattgcaggttttcatttagatacagatcaagcgccagttctagatgaattaaagaaaaatgttgaaaaacatgctgttgattttagccaaataaatattttagattatgacgataaaaaatcatatttcgaagcgttaggtgtaccagcaggtcaagtttatccaattgcttatgaaaaagatgcaatcgaattaatcgctgataagattaaaactaaagaaaataaagggaaattaacattacaagttgtttctatcgatgagcaaggtaagttaaatgttagtattcgtcaaggactaatggaagcaagagaaattttcttagtagtgacaggtgctaataaacgagatgtagttgaaaaattatatcaagaaaatggtaaaacaagcttcgaaccagccgatttaaaagcacatagaatggtaaatgttattcttgataaagaagcggctgcaggtttacctgaagatgttaaagcttactttacgtcacgctttgct

SEQ ID NO: 4630 - protein, 208 aa, Staphylococcus aureus
  MISC_FEATURE (1)..(208): hypothetical protein
MQTKRSVEIMAMNFKVFDNSQLVAEYAADIIRKQFNNNPTTIAGFHLDTDQAPVLDELKKNVEKHAVDFSQINILDYDDKKSYFEALGVPAGQVYPIAYEKDAIELIADKIKTKENKGKLTLQVVSIDEQGKLNVSIRQGLMEAREIFLVVTGANKRDVVEKLYQENGKTSFEPADLKAHRMVNVILDKEAAAGLPEDVKAYFTSRFA

SEQ ID NO: 4631 - DNA, 531 bp, Staphylococcus aureus
atgcatgcaatgcaatatcatgttaagttgcctagtgattacaatatggaaataattagagatagagttcgattaaatggttataagactgatggatttaaaaatttaattataaaagcttatttaataagtcaaacaactactaattgcattacaaatacttattcaccattatatttatggagaagttcagaggggatgactgaatttatattcaatggattttatgataatgttatttcttcttttggatggcaaaatataaatattggtgtgatatattcaatgaacataaccgattctgttaaacatagtctttatgcgcttgaagaatatatcgacattttccctactttatctctaaaagaaatagaaatcaaaaaattgtttagaatcttcgataatgcagttgcagaaattataatttataatcctgataagtggaagtttgtgaaatattcatttattgaaaatcttccaaagagtctcaatccaaatataaaaatttatgatgtactatatatctcacaa

SEQ ID NO: 4632 - protein, 177 aa, Staphylococcus aureus
MHAMQYHVKLPSDYNMEIIRDRVRLNGYKTDGFKNLIIKAYLISQTTTNCITNTYSPLYLWRSSEGMTEFIFNGFYDNVISSFGWQNINIGVIYSMNITDSVKHSLYALEEYIDIFPTLSLKEIEIKKLFRIFDNAVAEIIIYNPDKWKFVKYSFIENLPKSLNPNIKIYDVLYISQ

SEQ ID NO: 4633 - DNA, 858 bp, Staphylococcus aureus
ttgaacttaaacattttaaaatcatttttagtaactagtgaaacaaagaaccttactaaagcatcagagttacttaactattcacagtcaactgtatctacacatattgaaaaattagaaaggcaattagatgttaaattattttatagaaaaaaatatggtatggaactaacggaagaaggcttagcatacgttaaatatgctaaagtgattttagatagtaatagcgaatacgagagagaaataaaaggactttacaataagaaggtaaatataagtattaacatgcaagaaagtcagtatttgtatcgctactataataagattagtgaatggttagctgaacacccatatgtaaacttgaagtttaaatccgcacattctaatttctatattaaagaagaaattgctaatttcaaatcggatattagccttatcacagacgaaaagattattaatagtaacttaactgctattcctataactgaagaacgtttaatatttgttactaacaaagagatgaaagatttcaaattaaacgatattcaaaaccatacattacttgttactgaaaaagggtgtagttacagagaacagttagaaatgattttatataaatatagcttttcaacaaaacaaatgattgaatttctaggaattgagtcattaaaaaaacacttgaaaaattcaggtgggattgcgctattgccggaatttattgttgcagatgaattagaaaataaaagtttgtttcaaatagacgtagatgtcgatattccgaatttagaaacaacattgataattaatcctgaatcgaataagcaagtacttgaatcttttgtaaaagatgttttttta

SEQ ID NO: 4634 - protein, 286 aa, Staphylococcus aureus
  MISC_FEATURE (1)..(286): hypothetical protein
LNLNILKSFLVTSETKNLTKASELLNYSQSTVSTHIEKLERQLDVKLFYRKKYGMELTEEGLAYVKYAKVILDSNSEYEREIKGLYNKKVNISINMQESQYLYRYYNKISEWLAEHPYVNLKFKSAHSNFYIKEEIANFKSDISLITDEKIINSNLTAIPITEERLIFVTNKEMKDFKLNDIQNHTLLVTEKGCSYREQLEMILYKYSFSTKQMIEFLGIESLKKHLKNSGGIALLPEFIVADELENKSLFQIDVDVDIPNLETTLIINPESNKQVLESFVKDVFL

SEQ ID NO: 4635 - DNA, 555 bp, Staphylococcus aureus
atgactatgattacttgtttatttggaagtagtagaaaagatggcaattcagctatcgcagtagagaatctattgaagaatttaaaagtcaactttgtgaatttatatcaaagcaacattgaaaaggttacagataatcgtcatagcaaaggtgccaactttcataatgatgattacgaacaaattttaatcaaagttttagaatcagatattattattttttcaacaccactctattggtactccatgagtgcgtctttaaaactcttcattgatagatggaccgagtcattgcgagatacgcaaatagacaacttcaaagaaatcatgtcacaaaaaaagtatttgattttaatcataggtggcgacaatccgcataccaaagcacaacctttagtcaaccaattcaaattaatatttgagtttatgaatattactaactatagatttttgatcggcgaaggcaataaaccattcgatattttaaacgactctcaatttatagaagagctcgcaaatataaatcttgcattgaaaaaaggtgatatttatgac

SEQ ID NO: 4636 - protein, 185 aa, Staphylococcus aureus
  MISC_FEATURE (1)..(185): conserved hypothetical
MTMITCLFGSSRKDGNSAIAVENLLKNLKVNFVNLYQSNIEKVTDNRHSKGANFHNDDYEQILIKVLESDIIIFSTPLYWYSMSASLKLFIDRWTESLRDTQIDNFKEIMSQKKYLILIIGGDNPHTKAQPLVNQFKLIFEFMNITNYRFLIGEGNKPFDILNDSQFIEELANINLALKKGDIYD

SEQ ID NO: 4637 - DNA, 1227 bp, Staphylococcus aureus
gtgatatttatgactgatttgttgaaaattaaaaacttcagattgttctttttagcagaaataatttcagcattcggagttggaattagtacagttggggctaattggtatttaatcgacaaaactaacgactcccaactattaggtattatgttagctttaaatgtattatccggtttcttagcttctcctataataggtggactagccgataaatataatagacgaaatattattttaatcacctatcttcttcaggtaatattatatttactcattgtcatagcactcgtaatgataggatttgagacctatttagtgattggatttgcgattgttaatgggataggttggactacgtatatggcaacatctagaagtttagttaaacagatattaaaaccagatcaatatacagatgcaaattctctattagagattagtttgcaaacaggtatgtttattgcaggtggattatcaggaatattatataaaataaatggattcactctaattatagcgatgactataatgatgtttctaatcagcatttttatgttatttagattgcatgtagataaaccaactcattcagaggaagaatcaacaaatagcttattgcaagaatatttattaggatggaaatttttaaaagacaacatgatgatatttatttttggagttatttcaatcataccaatggtgtttacaatgatctttaacatatcattaccaggatatgtttataatgttttaaaactttcgtctgtacaatttggtttttcagatatgttatatggcattggaggattatgtgcaggtttaatttcagctattctttcgaagaaaatctcaactaaagtattgatatttttgttatatttcatattagtcataaattcagcactatttatttggataaactcagcattttacttattcataggatcatttatactaggctactcaatttcatcaatcagaatttatatgaatacagctataatgaacactgtttcagataaatatgtcggtcgctcatttacgatatggacgtcaatttcattgttactgcaaagtttaattgctccatttttaggaagatggattaatgaaattaatgataaattcggtttctatattatactcattttatccttactcatatttgttacactgctgcttgttaacaaaacagacaaaataaaatatgcacataaagaagag

SEQ ID NO: 4638 - protein, 409 aa, Staphylococcus aureus
  MISC_FEATURE (1)..(409): hypothetical protein
VIFMTDLLKIKNFRLFFLAEIISAFGVGISTVGANWYLIDKTNDSQLLGIMLALNVLSGFLASPIIGGLADKYNRRNIILITYLLQVILYLLIVIALVMIGFETYLVIGFAIVNGIGWTTYMATSRSLVKQILKPDQYTDANSLLEISLQTGMFIAGGLSGILYKINGFTLIIAMTIMMFLISIFMLFRLHVDKPTHSEEESTNSLLQEYLLGWKFLKDNMMIFIFGVISIIPMVFTMIFNISLPGYVYNVLKLSSVQFGFSDMLYGIGGLCAGLISAILSKKISTKVLIFLLYFILVINSALFIWINSAFYLFIGSFILGYSISSIRIYMNTAIMNTVSDKYVGRSFTIWTSISLLLQSLIAPFLGRWINEINDKFGFYIILILSLLIFVTLLLVNKTDKIKYAHKEE

SEQ ID NO: 4639 - DNA, 327 bp, Staphylococcus aureus
gtgattaaacataaaactgaaggagcgattacaatggcgactaagaaagatgtacatgatttatttttaaatcatgtgaattcaaacgcggttaagacaagaaagatgatgggagaatatattatttattatgatggcgtggttataggtggtttgtatgataatagattattggtcaaggcgactaaaagtgcccagcagaaattgcaagataatacattagtttcgccatatccaggttctaaagaaatgatattaattctagactttaccgaagcaacaaatctcactgatttatttaagaccataaaaaatgatttgaaaaag

SEQ ID NO: 4640 - protein, 109 aa, Staphylococcus aureus
  MISC_FEATURE (1)..(109): hypothetical protein
VIKHKTEGAITMATKKDVHDLFLNHVNSNAVKTRKMMGEYIIYYDGVVIGGLYDNRLLVKATKSAQQKLQDNTLVSPYPGSKEMILILDFTEATNLTDLFKTIKNDLKK

SEQ ID NO: 4641 - DNA, 201 bp, Staphylococcus aureus
atggaaggtttaaagcattctttaaaaagtttaggttggtgggatttattttttgcgatacctatttttctgctattcgcataccttccaaactataattttataactatatttcttaacattgttatcattattttcttttccataggtttgattttaactacgcatataattatagataaaattaagagcaacacgaaa

SEQ ID NO: 4642 - protein, 67 aa, Staphylococcus aureus
  MISC_FEATURE (1)..(67): hypothetical protein
MEGLKHSLKSLGWWDLFFAIPIFLLFAYLPNYNFITIFLNIVIIIFFSIGLILTTHIIIDKIKSNTK

SEQ ID NO: 4643 - DNA, 984 bp, Staphylococcus aureus
atgaaagaaaatttttggagtgaattaccacgtccattttttattttggcgccaatggaagacgttacagatatcgtctttcgacacgttgtaagtgaagcagctagaccggatgtgtttttcactgaatttacaaatactgaaagcttttgccaccctgaaggcatacatagtgtgcgcggacgcttaacttttagtgaagatgaacagccgatggtcgctcatatatggggagataagccagaacagttccgtgaaacgagtattcaattagctaaaatgggctttaaaggcatagacttaaatatgggatgtcctgtagcaaatgttgctaaaaagggtaagggttccggcttaatcttaagacctgacgttgctgccgaaattattcaagcgactaaagcaggtgggcttccggtaagtgttaaaacacgccttggctactatgaaatcgatgaatggaaagattggttgaagcacgtcttcgaacaagacattgccaatttatctattcatcttcgtacacgtaaagaaatgagtaaagtagatgcacattgggaattaatcgaagctattaaaaatttacgtgacgaaattgcaccaaatacattgttaacaattaacggtgatattcccgatagaaaaacaggacttgaactggcagaaaaatatggcattgatggcgtcatgattggtagaggcattttccacaatccattcgcttttgaaaaagaaccacgcgaacacacaagcaaggaactattagatctattgagattgcatttatcattgtttaacaaatatgaaaaagatgaaatacgacaattcaagagcttgcgtagattctttaaaatctatgtgcgtggcataagaggcgctagcgaacttcgacatcaattgatgaacacacaatcaattgcagaagcacgagcactactcgatgaatttgaagcccaaatggacgaagacgttaaaattgaatta

SEQ ID NO: 4644 - protein, 328 aa, Staphylococcus aureus
  MISC_FEATURE (1)..(328): conserved hypothetical
MKENFWSELPRPFFILAPMEDVTDIVFRHVVSEAARPDVFFTEFTNTESFCHPEGIHSVRGRLTFSEDEQPMVAHIWGDKPEQFRETSIQLAKMGFKGIDLNMGCPVANVAKKGKGSGLILRPDVAAEIIQATKAGGLPVSVKTRLGYYEIDEWKDWLKHVFEQDIANLSIHLRTRKEMSKVDAHWELIEAIKNLRDEIAPNTLLTINGDIPDRKTGLELAEKYGIDGVMIGRGIFHNPFAFEKEPREHTSKELLDLLRLHLSLFNKYEKDEIRQFKSLRRFFKIYVRGIRGASELRHQLMNTQSIAEARALLDEFEAQMDEDVKIEL

SEQ ID NO: 4645 - DNA, 99 bp, Staphylococcus aureus
ttgagtacacgtggtttgaatatctggcaagaaatggaaattggtaatgtcagtcataaagtcgctaaacgtgctcaaataccattaattatttttaaa

SEQ ID NO: 4646 - protein, 33 aa, Staphylococcus aureus
LSTRGLNIWQEMEIGNVSHKVAKRAQIPLIIFK

SEQ ID NO: 4647 - DNA, 1200 bp, Staphylococcus aureus
gtggaaaaaatgaataagcattatcaaattgttattattggtggcggtacagcaggtgttaccgtagcatcaagactattaagaaaaaatcaaaacttaaaagagaaaatagcaattatagatccagcagaccatcattactatcaaccattatggacgttggttggtgcaggggtatctagtttgaaaagttctcgtaaagatatggaaagtgttatacctgaaggtgctaactggataaaacaggctgtttcaagttttcaacctgaaaataatagcgttattttaggagataatacagtcgtttattatgattttttagtagtagctccaggattacagattaattggtcttcaattaaaggactaaaagaaaatataggtaaaaatggtgtttgctctaactattcacctgactatgttaacgaaacttggaaccaaatttctaattttaaacaaggaaatgccatttttacgcatccaaacactcctataaagtgtggaggtgcgcctatgaaaattatgtatttagctgaagattattttaggaaacataaaatccgttctaacgctaatgtgatatatgcaacgccaaaagatgctttatttgacgtaggaaaatataataaagaattagaaaggattgttgaagaaagaaatataacagtcaattataattataaccttgttgaaatcgacggtgacaaaaaagtggctacattcgaacatatcaaagcatacgatagaaaaacaataagttatgatatgttacatgtaacaccacctatgggtcccttagatgtagtaaaagaaagtacactttcagatagtgagggttgggtagatgttaacccaaccacattacagcataaaagctactctaatgtatttgcacttggtgatgcttcaaatgtacctacttcaaaaacaggcgcagctattcgtaagcaagcacctatcgtcgctaataatttattgcaagtgatgaataatcaaatgttaacgcatcattatgatggttatacttcatgccctattgttactggatataataggttaatacttgcagagtttgattataataaaaatactaaagaaacaatgccgtttaatcaggccaaagaacgtagaagtatgtatatatttaagaaagatttattacctaaaatgtattggtacggcatgctaaaaggattaata

SEQ ID NO: 4648 - protein, 400 aa, Staphylococcus aureus
  MISC_FEATURE (1)..(400): hypothetical protein
VEKMNKHYQIVIIGGGTAGVTVASRLLRKNQNLKEKIAIIDPADHHYYQPLWTLVGAGVSSLKSSRKDMESVIPEGANWIKQAVSSFQPENNSVILGDNTVVYYDFLVVAPGLQINWSSIKGLKENIGKNGVCSNYSPDYVNETWNQISNFKQGNAIFTHPNTPIKCGGAPMKIMYLAEDYFRKHKIRSNANVIYATPKDALFDVGKYNKELERIVEERNITVNYNYNLVEIDGDKKVATFEHIKAYDRKTISYDMLHVTPPMGPLDVVKESTLSDSEGWVDVNPTTLQHKSYSNVFALGDASNVPTSKTGAAIRKQAPIVANNLLQVMNNQMLTHHYDGYTSCPIVTGYNRLILAEFDYNKNTKETMPFNQAKERRSMYIFKKDLLPKMYWYGMLKGLI

SEQ ID NO: 4649 - DNA, 1332 bp, Staphylococcus aureus
atgttttttaaacagttttacgataatcatttatctcaagcatcatatttagtgggttgtcaacgtacaggagaggcaataataatagaccctgttcgtgatttatcgaaatatatagaagttgcagattctgaaggtttaacaattacacaagctacagaaacacatattcatgctgattttgcttcaggaattcgtgatgtggctaaacgcttaaatgcaaatatatatgtgtctggcgaaggtgaagatgcattagggtataaaaatatgccatcaaaaacacaatttgttaaacatggagatatcattcaagtaggcaatgttaaattagaagttctgcatactccaggacacacgcctgaaagtattagctttttactcactgatttaggtggtggttcaagtgttccgatgggattatttagtggtgactttatttttgttggtgatataggtagacctgatttattagaaaaatctgttcaaataaagggttctacagaaattagcgcgaaacaaatgtatgagtccgttcaaaatattaaaaatttaccagactatgttcaaatctggccgggtcatggtgctggaagcccttgtggtaaagcattaggtgccatacctatatctacaataggttatgagaaaattaataactgggcatttaatgaaattgatgagactaaatttattgaatcattaacatcaaatcaaccagcaccaccgcatcattttgcacaaatgaaacaagttaatcagtttggtatgaatttatatcaatcatatgatgtttatcctagtttagataataagagagtagcatttgatcttcgtagcaaagaggcctttcacggtggccacacaaaaggaacaatcaatataccatacaacaaaaactttattaatcaaattggttggtacttagattttgaaaaagatatagatgtaattggagataaatctactgttgagaaagcgaaacacactttacaattaattgggtttgataaggtagcaggctatcgtttgccaaaatcaggcatttcaacccagtccgttcatagcgctgatatgacaggtaaagaagaacatgtattagacgtacgtaatgatgaagagtggaataatggacacttagatcaagcagttaatattccgcatggtaaattattaaatgaaaatattccttttaataaagaggataaaatatatgtacattgtcagtcaggtgttagaagttcaattgcagtgggtatattggaaagcaaaggttttgaaaatgtggtgaatattagagaaggctatcaagattttccagaatcattaaaa

SEQ ID NO: 4650 - protein, 444 aa, Staphylococcus aureus
  MISC_FEATURE (1)..(444): conserved hypothetical
MFFKQFYDNHLSQASYLVGCQRTGEAIIIDPVRDLSKYIEVADSEGLTITQATETHIHADFASGIRDVAKRLNANIYVSGEGEDALGYKNMPSKTQFVKHGDIIQVGNVKLEVLHTPGHTPESISFLLTDLGGGSSVPMGLFSGDFIFVGDIGRPDLLEKSVQIKGSTEISAKQMYESVQNIKNLPDYVQIWPGHGAGSPCGKALGAIPISTIGYEKINNWAFNEIDETKFIESLTSNQPAPPHHFAQMKQVNQFGMNLYQSYDVYPSLDNKRVAFDLRSKEAFHGGHTKGTINIPYNKNFINQIGWYLDFEKDIDVIGDKSTVEKAKHTLQLIGFDKVAGYRLPKSGISTQSVHSADMTGKEEHVLDVRNDEEWNNGHLDQAVNIPHGKLLNENIPFNKEDKIYVHCQSGVRSSIAVGILESKGFENVVNIREGYQDFPESLK

SEQ ID NO: 4651 - DNA, 468 bp, Staphylococcus aureus
atgacaaatcatatcgttttatatcaaccagaaatcccagctaatactggtaacattgcacgtacgtgtgcaggtacaaacacacatttacatttaattaaacctcttggatttagaactgatgataaaatgttaaaaagagccggtttagattattgggaatttgtgaatattacgtatcatgatagtattgaagcattttttgaagtcacaaatggcgagtattacttattaacaaaatttggtaaaaagacttatagtgattttgatttttcaaatcatgacaaagatttttacttcatttttggaaaagaaacgacaggattaccagactgggtgaaagagaaatatcaagacacagcgttaagaattcctatgagtgaacatattcgttcattaaatttatcaaatactgctgcgttgttaatttatgaagcgttacgtcaacaagattttccgggattgaat

SEQ ID NO: 4652 - protein, 156 aa, Staphylococcus aureus
  MISC_FEATURE (1)..(156): conserved hypothetical
MTNHIVLYQPEIPANTGNIARTCAGTNTHLHLIKPLGFRTDDKMLKRAGLDYWEFVNITYHDSIEAFFEVTNGEYYLLTKFGKKTYSDFDFSNHDKDFYFIFGKETTGLPDWVKEKYQDTALRIPMSEHIRSLNLSNTAALLIYEALRQQDFPGLN

SEQ ID NO: 4653 - DNA, 1065 bp, Staphylococcus aureus
atgaaacaatacggagaaaagtttatcgatgaatttagtaaagcagaattggaaaaactagccaagcaagggcaattaattgacgttagaacagaagaggagtatgcattaggacatatcaatggttccatacttcatcctgttgatgagattgagtcattcaataaagaaaaaaataaaacctattatgtaatctgtagaagtggtaacagaagtgctaatgctagtaaatatttagctaaacaaggttataacgttataaatcttgatggtggttataaagcttatgaagaagaaaacgatagttatgatacacaagaagaatataaaagtatagaaattaaagcagatcgtaaacaatttaactatcgtggtcttcaatgtccagggccaattgtaaaaattagtcaagaaatgaagaatattgaagtaggtgaccaaattgaagtcaaagtcacagaccctggattccctagtgacattaaaagttgggtgaaacaaacaaggcatactttagttaagcttgatgaaaataacaatggaattaatgcgattattcaaaaagaaaaagcaaaagatttagatataaattattctgctaaaggtactacaattgtattatttagtggagaattagacaaagctgtagcagcgttgattattgcaaatggtgctagagctgctggaaaagatgtaactatcttctttactttttgggggcttaatgcattaaaaaaagtgcaaacagttaatgttaaaaagcaaggtattgcaaaaatgtttgatttaatgttgcccaaaaagaatatacgaatgcctctttccaaaatgaatatgtttggtttaggaaatatgatgatgcgctacgtaatgaaaaagaaaaatgttgattcattaccaacacttatcaatcaagctattgagcaaaatatcaaattaatcgcttgtacgatgagtatggatgtcatgggtattcagaaagaagaacttagagatgaagttgagtacggtggtgtaggcacttatattggtgctactgaaaatgcgaatcataatttatttatc

SEQ ID NO: 4654 - protein, 355 aa, Staphylococcus aureus
  MISC_FEATURE (1)..(355): conserved hypothetical
MKQYGEKFIDEFSKAELEKLAKQGQLIDVRTEEEYALGHINGSILHPVDEIESFNKEKNKTYYVICRSGNRSANASKYLAKQGYNVINLDGGYKAYEEENDSYDTQEEYKSIEIKADRKQFNYRGLQCPGPIVKISQEMKNIEVGDQIEVKVTDPGFPSDIKSWVKQTRHTLVKLDENNNGINAIIQKEKAKDLDINYSAKGTTIVLFSGELDKAVAALIIANGARAAGKDVTIFFTFWGLNALKKVQTVNVKKQGIAKMFDLMLPKKNIRMPLSKMNMFGLGNMMMRYVMKKKNVDSLPTLINQAIEQNIKLIACTMSMDVMGIQKEELRDEVEYGGVGTYIGATENANHNLFI

SEQ ID NO: 4655 - DNA, 264 bp, Staphylococcus aureus
atgactatgaattatgataaaaaaatgattaatcgtattaatagaatacaagggcaactaaatggaattattaaaatgatggaggaaggaaaagactgtaaagatgtcattacacaaataagtgcatcaaagagttcactccaacgcttgatgggtatcattattagtgagaatttaatagaatgtgtaaaagcagctgcggatgatgaagaaagctcccaagagttaattaatgaagctgtaaacttattggtgaaaagtaag

SEQ ID NO: 4656 - protein, 88 aa, Staphylococcus aureus
  MISC_FEATURE (1)..(88): conserved hypothetical
MTMNYDKKMINRINRIQGQLNGIIKMMEEGKDCKDVITQISASKSSLQRLMGIIISENLIECVKAAADDEESSQELINEAVNLLVKSK

SEQ ID NO: 4657 - DNA, 753 bp, Staphylococcus aureus
atggatattgttaatatagttatcatgttactcattggggtattcggtgggttcatatctggtctagtaggcgtaggtggtgctatcattatttatccagctattttattattaccaccattattcggagcccctgcatatagcgcatatatcgcatcaggtcttacttctagccaagtctttttcagtacattaagtggctcattaaaagctcgaaaaaaaacagagttctcgccacaattagttctttatatgggtggcggcatgattatagggagtatgttaggtgcatttctagcaaatttatttgatgctacatttgtaaatacggtatatatcattattgctttacttgcattaacattaatgtttattaaagtgaaacctagttccgaaaagtcttcatttaataaatatttattagttatcattggccttttcattggtattatttcaggtatagtaggtgcaggtggtgccttcattattattcctatattattggttttattcaaattaccaatgaatactgtagtcgctaatagtatagtaattgcttttatatcttcaattggtgcttttgtcatcaaacttattcaaggttatatccctttatatgacgccttattccttataatagggagtattatatttgctccaatagggttaaaattaagtaaaaaagtccctaacataatacaaaaatggattatcagtattttaatcgtttttgctatagttcaactcatttta

SEQ ID NO: 4658 - protein, 251 aa, Staphylococcus aureus
  MISC_FEATURE (1)..(251): conserved hypothetical
MDIVNIVIMLLIGVFGGFISGLVGVGGAIIIYPAILLLPPLFGAPAYSAYIASGLTSSQVFFSTLSGSLKARKKTEFSPQLVLYMGGGMIIGSMLGAFLANLFDATFVNTVYIIIALLALTLMFIKVKPSSEKSSFNKYLLVIIGLFIGIISGIVGAGGAFIIIPILLVLFKLPMNTVVANSIVIAFISSIGAFVIKLIQGYIPLYDALFLIIGSIIFAPIGLKLSKKVPNIIQKWIISILIVFAIVQLIL

SEQ ID NO: 4659 - DNA, 450 bp, Staphylococcus aureus
atgagtaaagtagatgcacattgggaattaatcgaagctattaaaaatttacgtgacgaaattgcaccaaacacattgttaacaattaacgatgatattcccgatagaaaaacaggacttgaacttgcagaaaaatatggtattgatggcatcatgattggtagaggcattttccacaatccattcacttttgaaaaagaaccacgcgaacacacaagcaaagaactattagatttgttgagattgcatctatcattgtttaacaaatatgagaaagatgaaatacgacaattcaagagtttgcgtagattctttaaaatctatgtgcgtggcataagaggcgctagcgaacttcgccatcaattgatgaacacacaatcaattgcagaagtacgagcactactagatgaatttgaagcccaaatggacgaagacgttaaaattgaatta

SEQ ID NO: 4660 - protein, 150 aa, Staphylococcus aureus
  MISC_FEATURE (1)..(150): conserved hypothetical
MSKVDAHWELIEAIKNLRDEIAPNTLLTINDDIPDRKTGLELAEKYGIDGIMIGRGIFHNPFTFEKEPREHTSKELLDLLRLHLSLFNKYEKDEIRQFKSLRRFFKIYVRGIRGASELRHQLMNTQSIAEVRALLDEFEAQMDEDVKIEL

SEQ ID NO: 4661 - DNA, 1743 bp, Staphylococcus aureus
atgaagattaatatttataaatctatttataattttcaggaaacaaatacaaattttttagagaatctagaatctttaaatgatgacaattatgaactgcttaatgataaagaacttgttagtgattcaaatgaattaaaattaattagtaaagtttatatacgtaaaaaagacaaaaaactattagattggcaattattaataaagaatgtatacctagatactgaagaagatgacaatttattttcagaatccggtcatcattttgatgcaatattatttctcaaagaagatacaacattacaaaataatgtatatattataccttttggacaagcatatcatgatataaataatttgattgattatgacttcggaattgattttgcagaaagagcaatcaaaaatgaagacatagttaataaaaatgttaatttttttcaacaaaacaggcttaaagagattgttaattatagaaggaatagtgtagattacgttagaccttcagaatcttatatatcagtccaaggacatccacagaatcctcaaatttttggaaaaacaatgacttgtggtacaagtatttcattgcgtgtaccgaatagaaagcagcaattcatagataaaattagtgtgataatcaaagaaataaacgctattattaatcttcctcaaaaaattagtgaatttcctagaatagtaactttaaaagacttgaataaaatagaagtattagatactttattgctaaaaaaactatcgaattcttcaactacagaaaatatatctatagatatatcaagatttttagaactaagtaatatgatactcttgttagatgatatgctcgacgtcaatatatatataaattcttttaaaaataatacattagagacatttgatgcgactgatcctgaagttgattacatcactgaaataggagattacttattaaaatatgacgttaattctataaatgatgtcagaattgaagtgatagataatttggggcattcaaataatatgctactaaaaacgatactacatgcagaagttgaaatggaagatggaaagaaatatttattacaaaatgggaaatggggttattttaatagagaattttttgaccttttgaatgatcatttgaatgagatagaaattaggtataacacactaactcccacaggtttagtatttaaagaaggagaagaaggatatataaaagaaatagtaggaagattgccagaagaatatttaatgttacataaaaaattcataaaaccaataaataagaattttatagtaaaaggaaatggaatagagttggcagacttatacaatattaaaaacaaagagcttttcacgattaaaagaggaattaatacatctttatctctttatagtctagaacagaatataatagcaattaacgccttaaaatatccagaatcatataattttgaagaattaatagaagctattcctgataactcggaaaatatatttaatgatatacaacggagtacaaattttagtatagtatggattttaccgatatcatctattgataatatgcccataaaagatatggttcatactagtaacgtaataaataaaaactttcaattaactaatttaggttcagtattacttaaaaataaattagtagagtggtctctctatttaaaagatcaaagaattaatccaattatttatatggaaacgccaactgaagatagaaat

SEQ ID NO: 4662 - protein, 581 aa, Staphylococcus aureus
  MISC_FEATURE (1)..(581): hypothetical protein
MKINIYKSIYNFQETNTNFLENLESLNDDNYELLNDKELVSDSNELKLISKVYIRKKDKKLLDWQLLIKNVYLDTEEDDNLFSESGHHFDAILFLKEDTTLQNNVYIIPFGQAYHDINNLIDYDFGIDFAERAIKNEDIVNKNVNFFQQNRLKEIVNYRRNSVDYVRPSESYISVQGHPQNPQIFGKTMTCGTSISLRVPNRKQQFIDKISVIIKEINAIINLPQKISEFPRIVTLKDLNKIEVLDTLLLKKLSNSSTTENISIDISRFLELSNMILLLDDMLDVNIYINSFKNNTLETFDATDPEVDYITEIGDYLLKYDVNSINDVRIEVIDNLGHSNNMLLKTILHAEVEMEDGKKYLLQNGKWGYFNREFFDLLNDHLNEIEIRYNTLTPTGLVFKEGEEGYIKEIVGRLPEEYLMLHKKFIKPINKNFIVKGNGIELADLYNIKNKELFTIKRGINTSLSLYSLEQNIIAINALKYPESYNFEELIEAIPDNSENIFNDIQRSTNFSIVWILPISSIDNMPIKDMVHTSNVINKNFQLTNLGSVLLKNKLVEWSLYLKDQRINPIIYMETPTEDRN

SEQ ID NO: 4663 - DNA, 90 bp, Staphylococcus aureus
ttgacaaaaaatagtaaatataccaatgaagtttcaaaagaacaattccaagaaattgagaatgtaaataataaggtcaaagaattttat

SEQ ID NO: 4664 - protein, 30 aa, Staphylococcus aureus
LTKNSKYTNEVSKEQFQEIENVNNKVKEFY

SEQ ID NO: 4665 - DNA, 477 bp, Staphylococcus aureus
atgaaaatcaccattttagctgtagggaaactaaaagagaaatattggaagcaagccatagcagaatatgaaaaacgtttaggcccatacaccaagatagacatcatagaagttccagacgaaaaagcaccagaaaatatgagtgacaaagaaattgagcaagtaaaagaaaaagaaggccaacgaatactagccaaaatcaaaccacaatccacagtcattacattagaaatacaaggaaagatgctatcttccgaaggattggcccaagaattgaaccaacgcatgacccaagggcaaagcgactttgttttcgtcattggcggatcaaacggcctgcacaaggacgtcttacaacgcagtaactacgcactatcattcagcaaaatgacattcccacatcaaatgatgcgggttgtgttaattgaacaagtgtacagagcatttaagattatgcgaggagaggcgtatcataag

SEQ ID NO: 4666 - protein, 159 aa, Staphylococcus aureus
  MISC_FEATURE (1)..(159): conserved hypothetical
MKITILAVGKLKEKYWKQAIAEYEKRLGPYTKIDIIEVPDEKAPENMSDKEIEQVKEKEGQRILAKIKPQSTVITLEIQGKMLSSEGLAQELNQRMTQGQSDFVFVIGGSNGLHKDVLQRSNYALSFSKMTFPHQMMRVVLIEQVYRAFKIMRGEAYHK

SEQ ID NO: 4667 - DNA, 414 bp, Staphylococcus aureus
  MISC_FEATURE (1)..(414): n = g, a, t, or c
atgaatcaagtgaataacaacatattgcctgctataagaaacattaaagatttagagaaactgattaaaacagactataaaatgtgtgtgcttctagatatgcatataggacatataaaaagtattatggaattgctgaagcaaaatcatatagagtgttttattcatatagatttgataaaaggtttaagccacgatgaatttgcaagtgaatttattattcagcaatacaagccaaaaggtatcgtatcgactaaatctaaagtaataaaaaaagctaaatcattaaatactttaacgatttttagagtatttattattgatagtcaagcattgaaacgcagtatagatttgataaaaaaagttgaacctgattttgttgaagtacttccaggtgttgcgagtaaagnnnnn

SEQ ID NO: 4668 - protein, 138 aa, Staphylococcus aureus
  MISC_FEATURE (1)..(138): Xaa = any amino acid
  MISC_FEATURE (1)..(138): glycerol uptake operon
MNQVNNNILPAIRNIKDLEKLIKTDYKMCVLLDMHIGHIKSIMELLKQNHIECFIHIDLIKGLSHDEFASEFIIQQYKPKGIVSTKSKVIKKAKSLNTLTIFRVFIIDSQALKRSIDLIKKVEPDFVEVLPGVASKXX

SEQ ID NO: 4669 - DNA, 2007 bp, Staphylococcus aureus
atggggaaaattaaagaactccaaacctcattagcaaataaaatcgcagcaggtgaagtagttgaaagaccgagttctgttgtgaaagaactgttggaaaatgctatagatgcaggcgctacagaaataagcattgaagtagaggaatctggcgtccaatctattcgcgtagtcgataatggaagcggaattgaagcggaagacttaggattagtatttcatagacatgcgactagtaaattagatcaagatgaagatttatttcatattaggacattaggattccgtggtgaagcactagccagtatttcatcagttgctaaagtaacattgaagacttgcacggataatgctaatggaaatgaaatatatgtagaaaatggtgaaatattaaatcataagcctgcaaaagcgaaaaaaggaacagatatacttgtagaatcattattttataatacaccagcacgtttaaaatatattaaaagtttatacactgaactaggtaaaataacagatattgtcaacagaatggcaatgagccatccggacattcgaatagcactcatttcagatggcaaaacaatgttaagtacaaatggttcaggacgaactaatgaagtgatggcagagatttatgggatgaaagttgcacgagatttagtacatatatctggagatacaagtgattatcacattgaaggttttgttgcaaagcctgaacattctagaagtaataagcactatatttctatttttattaatggacgatacattaaaaactttatgctaaataaagcgattttagaaggctatcatacactcttaacaataggtaggttcccgatttgttatattaatattgaaatggatccaatcttagtagacgtaaatgttcatccaacaaaactagaagtgcgtttatcaaaagaagagcaactataccaattgattgtgagcaaaatacaagaagcatttaaagaccgtatattaattcctaaaaataacttggattatgtgccaaaaaaaaataaagtattacattcattcgaacaacaaaaaatcgaatttgaacaaagacaaaacacagagaataaccaagagaagacgttttcatctgaagaaagtaacagtaagccatttatggaagaaaatcaaaacgatgagatagttataaaagaagattcatataatccattcgtaacgaaaacatctgaaagtttaatagctgatgatgaatcttctggttataataatacacgtgaaaaagatgaagactacttcaaaaaacaacaagaaattttacaagaaatggatcaaacatttgattcaaatgatggtacaactgtgcaaaattatgagaataaagcgtctgatgattattatgatgtaaacgatattaaaggaacaaaaagtaaagaccctaaacgaagaattccatatatggaaattgttggacaagtacatggaacgtatattattgctcaaaatgaatttggcatgtacatgattgaccagcatgcagctcaagaaagaataaaatatgaatattttcgagataaaataggtgaggttaccaatgaagtacaagatttattaatcccgttaacatttcatttttcaaaagatgaacaattagtcattgatcaatataaaaatgagcttcaacaagtaggtatcatgttagaacattttggtggtcatgattatattgtaagtagctatccagtttggttccctaaagatgaagtagaagaaattattaaagatatgattgagctaattttggaagagaaaaaagtagatatcaaaaaattacgtgaagatgtagcaatcatgatgtcatgtaaaaaatccattaaagcgaatcattatttacaaaaacatgaaatgtctgatttaattgatcaattaagagaagcggaagatccatttacatgtccacatggtcgtccaataatcattaatttttcaaaatacgaattagaaaaattatttaagcgtgtgatg

SEQ ID NO: 4670 - protein, 669 aa, Staphylococcus aureus
  MISC_FEATURE (1)..(669): DNA mismatch repair protein
MGKIKELQTSLANKIAAGEVVERPSSVVKELLENAIDAGATEISIEVEESGVQSIRVVDNGSGIEAEDLGLVFHRHATSKLDQDEDLFHIRTLGFRGEALASISSVAKVTLKTCTDNANGNEIYVENGEILNHKPAKAKKGTDILVESLFYNTPARLKYIKSLYTELGKITDIVNRMAMSHPDIRIALISDGKTMLSTNGSGRTNEVMAEIYGMKVARDLVHISGDTSDYHIEGFVAKPEHSRSNKHYISIFINGRYIKNFMLNKAILEGYHTLLTIGRFPICYINIEMDPILVDVNVHPTKLEVRLSKEEQLYQLIVSKIQEAFKDRILIPKNNLDYVPKKNKVLHSFEQQKIEFEQRQNTENNQEKTFSSEESNSKPFMEENQNDEIVIKEDSYNPFVTKTSESLIADDESSGYNNTREKDEDYFKKQQEILQEMDQTFDSNDGTTVQNYENKASDDYYDVNDIKGTKSKDPKRRIPYMEIVGQVHGTYIIAQNEFGMYMIDQHAAQERIKYEYFRDKIGEVTNEVQDLLIPLTFHFSKDEQLVIDQYKNELQQVGIMLEHFGGHDYIVSSYPVWFPKDEVEEIIKDMIELILEEKKVDIKKLREDVAIMMSCKKSIKANHYLQKHEMSDLIDQLREAEDPFTCPHGRPIIINFSKYELEKLFKRVM

SEQ ID NO: 4671 - DNA, 1140 bp, Staphylococcus aureus
atggggggcatacgattggatacaaagcaattaaagcaagatatcattgactatgcatatacaattggtatcgacagtattggatttactactgccgatccctttgatgaattgaagcaaaagctagaagcatatcatgcaaatggttatgcctcaggatttgaagaatctgatattgctttacgaacggagcctaaattatccttaccaacagcaaggtcaatcatagcaattgcagttggttatcctaacaaactgaaaggtgcacctaagagtgttagaggtgatcgcagaggcttatttgctagagcatcgtggggtcaagattatcatacaattatgcgtaaacgattagacatgttagctgcatttattgaatctaaagttccagatgttgaaatcaaatctatggtagatacgggtgtattatcagatagggcagtagcagaacgtgcaggtttaggatttgttggtcgtaatggctttgtcatcaatcctaaactaggaacatggacatacctcggtgaaatgttagtcagtataccttttgaacctgatgatccattattagatagctgtggtgattgtacaatttgtgttgatcgttgtccaacaagtgcattagttggaaatggccaattaaatagtcagaaatgcattagttttttaacgcaaacaaaaggctatatgcctgaccaatatcgttataaaattgggaatagattatatggttgcgatacgtgtcaacaagtttgtccgaaaaatagaggtattaataccgaacaagatgacatcattttggaaccagaaattttaaagccaagattagtacctttactacgtatgtctaataaagaattcaaacaaacatatggtcaccttgcaggtgcttggcgtggtaaaaagccgatacaacgaaatgctattttagcattggcgcattttaatgaagtggatgcaattccagaattgaaaaaagttgcaacaacagatgaaagaccgttgattcgagcaactgcttattgggccattggtcaaattcttggggaagaagcaagagattttatcaatgctaattatgatcaagaggatgcagaagttcagaatgaaatgataaaaggattagacacaaggagagaa

SEQ ID NO: 4672 - protein, 380 aa, Staphylococcus aureus
  MISC_FEATURE (1)..(380): conserved hypothetical
MGGIRLDTKQLKQDIIDYAYTIGIDSIGFTTADPFDELKQKLEAYHANGYASGFEESDIALRTEPKLSLPTARSIIAIAVGYPNKLKGAPKSVRGDRRGLFARASWGQDYHTIMRKRLDMLAAFIESKVPDVEIKSMVDTGVLSDRAVAERAGLGFVGRNGFVINPKLGTWTYLGEMLVSIPFEPDDPLLDSCGDCTICVDRCPTSALVGNGQLNSQKCISFLTQTKGYMPDQYRYKIGNRLYGCDTCQQVCPKNRGINTEQDDIILEPEILKPRLVPLLRMSNKEFKQTYGHLAGAWRGKKPIQRNAILALAHFNEVDAIPELKKVATTDERPLIRATAYWAIGQILGEEARDFINANYDQEDAEVQNEMIKGLDTRRE

SEQ ID NO: 4673 - DNA, 2616 bp, Staphylococcus aureus
atgtctaatgttacaccaatgatgcagcaatatttaaaaataaaatcagaataccaagattgcttattattttttagactaggtgatttctatgaaatgttttatgaagatgccaaggaggcatcacgtgtacttgaaattactttaactaaaagagatgctaaaaaagaaaatccaattccgatgtgtggtgttccgtatcattctgcagatagttatatagatacacttgttaataatggatataaagtagctatttgtgaacagatggaagatccgaaacaaacgaaaggtatggttagacgtgaggtagtaagaattgtgactccaggaactgtgatggagcaaggtggtgtagatgataaacaaaataactatattttaagttttgttatgaatcaacctgaaattgcgcttagttactgtgatgtttctactggcgaattaaaggttacacattttaatgatgaagcgactttattaaatgaaattacgacgataaaccctaacgaagttgttatcaatgacaatatttccgataatttaaaaagacaaattaatatggtgacagaaacaataacagtcagggaaacgttatcatcagaaatctatagtgtgaatcaaactgaacataaattaatgtatcaagcgacacaattattgctagattatattcatcatacacaaaaacgtgatttatcgcatatcgaggatgttgttcaatatgcagctatagattatatgaaaatggatttttatgctaagagaaaccttgagttaacggaaagcattcgattaaaatcaaaaaaaggaacgctactttggctaatggacgaaacgaaaacaccaatgggagcacgccgcttaaaacaatggatagatagaccactaataagtaaagaacaaattgaagcacgattagatatcgttgatgaatttagtgctcatttcatagaaagagacaccttaagaacatatcttaatcaagtgtatgatattgaacgtcttgttgggcgtgttagttacggaaatgttaatgcgagagatttaattcaacttaaacattccatttctgaaataccgaatattaaagcattactaaattctatgaatcagaatactcttgtacaagttaatcaactagaaccccttgatgatttacttgatatattagaacagagtttagtagaagaaccaccaatttcagttaaagatggcggactattcaaagttggttttaatacgcaattagatgaatatcttgaagcttcaaaaaacggaaaaacatggttagcagaattacaagccaaagaaagacaacgtacaggaataaaatcattgaaaataagctttaataaagtgtttggttattttatagaaataacacgtgccaacttgcaaaattttgaaccaagtgaatttggttatatgaggaagcaaacgttatcgaatgctgaacgttttataactgatgaacttaaagaaaaagaagatatcattttaggtgcggaagacaaagccatcgaattagaatatcaattatttgttcagctacgtgaagaagttaaaaaatatactgaacgtttacaacaacaagctaaaattatttcagagctagattgtttacagagctttgcagaaattgctcaaaaatataattacactaggccttcatttagtgaaaataaaacattagaattagtggaatctaggcacccagtagtggaaagagtaatggattataatgactatgtgcctaataattgtcgattagataatgaaacatttatatatttaattacaggtccgaatatgtctggtaaatcgacatatatgagacaagttgccataattagtataatggcccaaatgggagcttatgtcccttgtaaagaggcagtgttacctatatttgatcaaatattcactagaataggtgcggcagatgatttggtttcaggtaagagtacgtttatggtagaaatgctagaagcacaaaaggcattaacttatgcaacagaggatagtttgattattttcgatgaaattggacgtggtacttcaacgtatgacggtttagctttagcgcaggcaatgatagagtatgtagctgaaacatcacatgctaaaacgttattttcaacacattatcatgaattgacaacattagatcaagcattaccaagtctaaaaaatgttcacgtcgctgctaatgaatataaaggtgaacttatattcttgcataaagtcaaagatggtgcagttgacgatagttatggtattcaagttgcgaaattagctgatttacctgaaaaagttattagcagagcacaagtgattctaagcgagtttgaagcgtctgctggtaaaaaatcatcgatatcaaatttaaaaatggtcgaaaatgaacctgaaattaatcaagaaaatttaaacttaagtgttgaagaaacaactgatactttatctcaaaaagactttgaacaagcatcatttgatttgtttgaaaatgatcaaaaaagcgagattgaactacaaattaaaaatttgaatttatctaatatgacaccaattgaggcattggtgaagttaagtgaattacaaaatcaattaaaa

SEQ ID NO: 4674 - protein, 872 aa, Staphylococcus aureus
  MISC_FEATURE (1)..(872): DNA mismatch repair protein
MSNVTPMMQQYLKIKSEYQDCLLFFRLGDFYEMFYEDAKEASRVLEITLTKRDAKKENPIPMCGVPYHSADSYIDTLVNNGYKVAICEQMEDPKQTKGMVRREVVRIVTPGTVMEQGGVDDKQNNYILSFVMNQPEIALSYCDVSTGELKVTHFNDEATLLNEITTINPNEVVINDNISDNLKRQINMVTETITVRETLSSEIYSVNQTEHKLMYQATQLLLDYIHHTQKRDLSHIEDVVQYAAIDYMKMDFYAKRNLELTESIRLKSKKGTLLWLMDETKTPMGARRLKQWIDRPLISKEQIEARLDIVDEFSAHFIERDTLRTYLNQVYDIERLVGRVSYGNVNARDLIQLKHSISEIPNIKALLNSMNQNTLVQVNQLEPLDDLLDILEQSLVEEPPISVKDGGLFKVGFNTQLDEYLEASKNGKTWLAELQAKERQRTGIKSLKISFNKVFGYFIEITRANLQNFEPSEFGYMRKQTLSNAERFITDELKEKEDIILGAEDKAIELEYQLFVQLREEVKKYTERLQQQAKIISELDCLQSFAEIAQKYNYTRPSFSENKTLELVESRHPVVERVMDYNDYVPNNCRLDNETFIYLITGPNMSGKSTYMRQVAIISIMAQMGAYVPCKEAVLPIFDQIFTRIGAADDLVSGKSTFMVEMLEAQKALTYATEDSLIIFDEIGRGTSTYDGLALAQAMIEYVAETSHAKTLFSTHYHELTTLDQALPSLKNVHVAANEYKGELIFLHKVKDGAVDDSYGIQVAKLADLPEKVISRAQVILSEFEASAGKKSSISNLKMVENEPEINQENLNLSVEETTDTLSQKDFEQASFDLFENDQKSEIELQIKNLNLSNMTPIEALVKLSELQNQLK

SEQ ID NO: 4675 - DNA, 489 bp, Staphylococcus aureus
atgaaatcaagaaaactggctataactgcacttttaattgcaataaatgttgtattaagcagtattatcatcattcctctaggaccagttaaggcagcaccagtacagcattttgtaaatgtattaagtgcggtcatagtaggtccttggtatggattagctcaagcgcttatatcatcaattttaagagttctttttggtactggtacagcttttgcatttccgggtagtatgattggagttttattggctagtatgttttacatatatcgtaaacatatatttatggccgcggtcggtgaagtacttggaactggtgtcatcggaagtttaatttgtataccattagcatatttccttgggcttcaagacttcttcattaaaccgttaatgattacgttcatagtctcaagtgctatcggatctattataagttatttcttattaattactctaaaaaaacgtggtattcttcaaaggtttataaaa

SEQ ID NO: 4676 - protein, 163 aa, Staphylococcus aureus
  MISC_FEATURE (1)..(163): conserved hypothetical
MKSRKLAITALLIAINVVLSSIIIIPLGPVKAAPVQHFVNVLSAVIVGPWYGLAQALISSILRVLFGTGTAFAFPGSMIGVLLASMFYIYRKHIFMAAVGEVLGTGVIGSLICIPLAYFLGLQDFFIKPLMITFIVSSAIGSIISYFLLITLKKRGILQRFIK

SEQ ID NO: 4677 - DNA, 363 bp, Staphylococcus aureus
atgtataataaagatgacgtgttgaaccaagcggataatattgcaaataaaattaaaaatttggatactatcaaaacatatcaacaaattgaagcacagattcatcagaaccaaacgataaagactaaaatggatatgttaaaaaagcatcaaaaacaagcagtaaactttcaaaattacgggaaacaaaatgcgctagaacagtcggaacataccattcagagtatagaagcagaaataaatacattgcccatagttgaacagtttcaaacttcacaatatgaagcgaatcaattattgaaaatgtttgtatcaacaatggaaacacgtttaaatgaccataataaagccaagcatagtgat

SEQ ID NO: 4678 - protein, 121 aa, Staphylococcus aureus
  MISC_FEATURE (1)..(121): conserved hypothetical
MYNKDDVLNQADNIANKIKNLDTIKTYQQIEAQIHQNQTIKTKMDMLKKHQKQAVNFQNYGKQNALEQSEHTIQSIEAEINTLPIVEQFQTSQYEANQLLKMFVSTMETRLNDHNKAKHSD

SEQ ID NO: 4679 - DNA, 1542 bp, Staphylococcus aureus
gtgaacgaagaacaaagaaaagcaagttctgtagatgttttagctgagagagataagaaagcagaaaaagattatagtaaatattttgaacatgtttatcagccgcctaatttaaaagaagcgaaaaaaagaggtaaacaagaagttcgttataatagagatttccaaattgatgaaaaatatcgcggtatggggaacgagcgtacatttttaattaaaacatatggatgtcaaatgaatgcacatgacactgaggtcattgctggtatacttgaagcattaggctatcaagcaacgactgatattaacactgcagatgttattttaattaatacatgtgcgattagagaaaatgccgagaacaaagtgtttagtgaaataggtaatttgaagcatttgaaaaaagaacgacctgatattttaatcggtgtttgtggttgtatgtcacaagaagagtcagtagtgaataaaattttaaaatcgtatcaaaatgtagatatgatatttggtacacataatattcatcatttaccagaaattttagaagaagcatacttatctaaagcaatggttgttgaagtatggtctaaagaaggagacgttattgaaaatcttccaaaagtccgtgaaggcaacattaaagcatgggtcaatattatgtatggttgtgataagttttgtacatattgtattgttccatttacaagaggtaaagaacgaagccgtagacctgaagacattatagatgaagtacgtgaacttgctcgtgaaggttacaaagaaataacgcttttaggtcaaaatgtaaattcttatggtaaagatttacaggatatagaatatgacttaggagatcttttacaagcaatttctaaaatagcgattccaagagttcgtttcacaacaagtcatccttgggactttacagatcacatgattgatgttatttcagagggtggtaatatcgttccgcatatccacttgccagttcaatctggaaataatgcagtattaaaaataatgggtagaaaatatacacgagaaagttatttggatttagtaaaacgaatcaaagatagaattcctaatgtagcattaactacagatattattgtagggtatccaaatgaatcagaggaacaatttgaagaaactttaactctgtatgatgaagttggttttgaacatgcatatacgtacttgtattcacaacgtgatggtacgcctgctgctaaaatgaaagataatgtacctttaaatgtcaaaaaggaacgattgcaacgtttgaataaaaaagttggtcattattcacaaatagctatgagtaagtacgaaggacaaactgtaacagtactttgtgaaggaagtagtaaaaaagatgatcaggttcttgctggctacactgataaaaataagctagttaatttcaaagcgcctaaagaaatgattggtaaactagtggaagtacgaatagatgaagctaaacagtattcattaaatggcagttttataaaggaagtagagccggaaatggtgattcaa

SEQ ID NO: 4680 - protein, 514 aa, Staphylococcus aureus
  MISC_FEATURE (1)..(514): conserved hypothetical
VNEEQRKASSVDVLAERDKKAEKDYSKYFEHVYQPPNLKEAKKRGKQEVRYNRDFQIDEKYRGMGNERTFLIKTYGCQMNAHDTEVIAGILEALGYQATTDINTADVILINTCAIRENAENKVFSEIGNLKHLKKERPDILIGVCGCMSQEESVVNKILKSYQNVDMIFGTHNIHHLPEILEEAYLSKAMVVEVWSKEGDVIENLPKVREGNIKAWVNIMYGCDKFCTYCIVPFTRGKERSRRPEDIIDEVRELAREGYKEITLLGQNVNSYGKDLQDIEYDLGDLLQAISKIAIPRVRFTTSHPWDFTDHMIDVISEGGNIVPHIHLPVQSGNNAVLKIMGRKYTRESYLDLVKRIKDRIPNVALTTDIIVGYPNESEEQFEETLTLYDEVGFEHAYTYLYSQRDGTPAAKMKDNVPLNVKKERLQRLNKKVGHYSQIAMSKYEGQTVTVLCEGSSKKDDQVLAGYTDKNKLVNFKAPKEMIGKLVEVRIDEAKQYSLNGSFIKEVEPEMVIQ

SEQ ID NO: 4681 - DNA, 291 bp, Staphylococcus aureus
atgaaagacacattaatgagtatacaaataattcctaaaacaccaaacaatgacaatgttataccttacgtagacgaggcgattaaaataattgacgaatctggtttgcattttagagtaggtccgttagaaacgacagtacaaggaaatatgaatgaatgtttaattttaatacaatcattaaatgaacgaatggtggaacttgaatgtccaagtattattagccaagttaagttttatcatgtgccagatggcatcactattgaaactttaactgaaaaatatgatgaa

SEQ ID NO: 4682 - protein, 97 aa, Staphylococcus aureus
  MISC_FEATURE (1)..(97): conserved hypothetical
MKDTLMSIQIIPKTPNNDNVIPYVDEAIKIIDESGLHFRVGPLETTVQGNMNECLILIQSLNERMVELECPSIISQVKFYHVPDGITIETLTEKYDE

SEQ ID NO: 4683 - DNA, 864 bp, Staphylococcus aureus
atggcgacatttaaagattttagaaataatgttaagcctaactggtgccccggatgtggcgatttctcagtacaagctgcaattcaaaaagcagccgcaaatatagggttagaacctgaagaagtagctatcatcaccggtataggatgttctggccgtctttcaggatatattaattcttatggcgttcattctattcacggacgtgcattacctttagctcaaggtgtaaaaatggcgaataaagatttaactgttattgcatcgggaggagatggtgatggttatgctataggtatggggcatacaatccatgctttaagaagaaatatgaacatgacgtatatagtcatggataatcaaatttatggtttgacaaagggacaaacatcgccgtcatcagcagtaggatttgttactaaaacaacgccaaaaggtaatatagaaaaaaatgttgcgcctttagaattagtattatcatctggtgccacatttgtagcccaaggtttttcaagcgatattaaaggattaacaaaactaattgaagatgcaattaatcatgatggattttcattcgttaatgtcttttcaccatgtgtgacttataataaaattaacacatacgattggtttaaagaacatttaacaagtgttgatgacattgaaaattatgattctacagataaacaattagcgactaaaactgttattgaacatgaatctttagtaactggtattgtttatcaagataaagaaacaccatcatatgaatctcaaattaaagagttagatgatacaccacttgctaaaagagatatcaaaattactgaagacaccttcaatgcattaactgaacaatttatt

SEQ ID NO: 4684 - protein, 288 aa, Staphylococcus aureus
  MISC_FEATURE (1)..(288): hypothetical protein
MATFKDFRNNVKPNWCPGCGDFSVQAAIQKAAANIGLEPEEVAIITGIGCSGRLSGYINSYGVHSIHGRALPLAQGVKMANKDLTVIASGGDGDGYAIGMGHTIHALRRNMNMTYIVMDNQIYGLTKGQTSPSSAVGFVTKTTPKGNIEKNVAPLELVLSSGATFVAQGFSSDIKGLTKLIEDAINHDGFSFVNVFSPCVTYNKINTYDWFKEHLTSVDDIENYDSTDKQLATKTVIEHESLVTGIVYQDKETPSYESQIKELDDTPLAKRDIKITEDTFNALTEQFI

SEQ ID NO: 4685 - DNA, 1803 bp, Staphylococcus aureus
ttgttatcatttaatatgaaatatatccataggaggcatataactatgaaaccacaattatcgtggaaagttggcggtcaacaaggcgaaggtattgaatcaactggggaaatcttcgctacggctatgaatagaaaaggatattatttatatggatatagacatttttcaagtcgtatcaaaggtggacatacgaataataaaattagagtttctacgacgcctgttcatgcaattagtgatgatttagatattttgattgcatttgaccaagaaacaattgatgttaaccatcatgaaatgagagaagacagtattattttagctgatgccaaggctaaacctgtgaaaccagaaggatgtcatgcacagcttattgaattaccttttacagcaaccgctaaagaattaggtacagcattaatgaaaaacatggttgcaataggtgctactagcgcattgatgaatttgaatacaaatacatttgaagaacttattactaatatgttttctaaaaaaggtgacaaggtagttgaagtcaatatccaagcattaaacgaaggttatcaattaatgcaatctcgcttacctgaaatctacggggactttgaattagagtcaacagatgcactaccacatctatatatgattggtaacgatgccattggattaggtgcaattgctgcaggttcacaatttatggcggcatatcctattacacctgcgtctgaagttatggaatatatgattgccaatatatctaaagtaaacggagcggttattcaaacagaagatgaaattgctgctgtaactatggctattggtgcaaattatggtggagtcagagcgtttacggctagtgctggtccaggtttatctttaatgatggaagcaattggattatctggtatgactgaaacgccattagtcattattaatacccaacgaggtggaccttctactggattacctacgaaacaagaacagtcagatttaatgcaaatgatttatggtacacatggtgatattccaaaaattgttgtagcaccaacagatgcagaagatgcattttatttaactatggaagcatttaatttagcagaacaatatcaatgccctgttatagttctaagtgatttgcaattatctttaggtaaacaaactgttgaaaaattagattataatcgtattgaaattaaacgtggtgaaatcattcaatctgatattgaacgtgaagaagatgataaaggttatttcaagcgttatgcgttaacatccgatggtgtttctcctagacctatccccggtgttaaaggaggtattcatcatataactggtgtggaacacaatgaagaaggtaaacctagtgaatctgcgtcaaatagacaacaacaaatggaaaaacgaatgcgtaaaattgagcagttactaattgaatcgccagtagaagctaacttacaacatgaggatgcagatattctttatatcggttttatttctacaaaaggtgcaattcaagaaggtagtaaccgtttgaatcaacaaggcataaaagttaacactatacaaattagacaattgcatccattcccaacaagcgttattcaagatgcagttaataaagcgaagaaagtcgttgtagtggagcacaattatcaaggacaattggctagtattataaaaatgaatgtcaatattcatgataagattgaaaattatacaaagtatgatgggacacctttcctaccacatgaaatcgaagaaaaaggcaaaataattgctactgaaataaaggagatggta

SEQ ID NO: 4686 - protein, 601 aa, Staphylococcus aureus
  MISC_FEATURE (1)..(601): hypothetical protein
LLSFNMKYIHRRHITMKPQLSWKVGGQQGEGIESTGEIFATAMNRKGYYLYGYRHFSSRIKGGHTNNKIRVSTTPVHAISDDLDILIAFDQETIDVNHHEMREDSIILADAKAKPVKPEGCHAQLIELPFTATAKELGTALMKNMVAIGATSALMNLNTNTFEELITNMFSKKGDKVVEVNIQALNEGYQLMQSRLPEIYGDFELESTDALPHLYMIGNDAIGLGAIAAGSQFMAAYPITPASEVMEYMIANISKVNGAVIQTEDEIAAVTMAIGANYGGVRAFTASAGPGLSLMMEAIGLSGMTETPLVIINTQRGGPSTGLPTKQEQSDLMQMIYGTHGDIPKIVVAPTDAEDAFYLTMEAFNLAEQYQCPVIVLSDLQLSLGKQTVEKLDYNRIEIKRGEIIQSDIEREEDDKGYFKRYALTSDGVSPRPIPGVKGGIHHITGVEHNEEGKPSESASNRQQQMEKRMRKIEQLLIESPVEANLQHEDADILYIGFISTKGAIQEGSNRLNQQGIKVNTIQIRQLHPFPTSVIQDAVNKAKKVVVVEHNYQGQLASIIKMNVNIHDKIENYTKYDGTPFLPHEIEEKGKIIATEIKEMV

SEQ ID NO: 4687 - DNA, 795 bp, Staphylococcus aureus
atgagaataatgtttataggggatatcgtaggtaaaattggacgagacgcaattgaaacgtacatacctcaactgaagcaaaagtataaaccaacagttacaattgtaaatgctgaaaatgcagcacatggtaaaggtttgactgaaaaaatatataaacaattactaagaaatggtgtagatttcatgactatgggtaatcacacatatggtcaacgtgaaatttatgattttatagatgaagcaaaacgactagtaagaccagcgaattttccggatgaagcgccgggaattggtatgagatttatacaaattaatgatattaaacttgcagttattaatctgcaaggaagagcgtttatgccagatattgatgatccttttaaaaaggcagatcaattagtcaaggaagcacaagaacaaactccgtttatatttgttgattttcatgcagaaacaacttctgaaaagtatgcaatgggatggcatttagatggtagagctagcgctgttgttggaacgcatacacacattcaaacagcagatgaacgtattttaccaaaggggacagggtatataacggatgttggtatgacaggtttttatgatggcattttaggaataaataaaacagaggtaattgagcgttttatcactagtttgccacaaagacatgttgttccaaatgaaggtagaagtgtattatctggtgttgttattgatttagacaaagaaggtaaaacaaagcacatcgaacgtatattgataaatgatgaccatccattttcaacattt

SEQ ID NO: 4688 - protein, 265 aa, Staphylococcus aureus
  MISC_FEATURE (1)..(265): conserved hypothetical
MRIMFIGDIVGKIGRDAIETYIPQLKQKYKPTVTIVNAENAAHGKGLTEKIYKQLLRNGVDFMTMGNHTYGQREIYDFIDEAKRLVRPANFPDEAPGIGMRFIQINDIKLAVINLQGRAFMPDIDDPFKKADQLVKEAQEQTPFIFVDFHAETTSEKYAMGWHLDGRASAVVGTHTHIQTADERILPKGTGYITDVGMTGFYDGILGINKTEVIERFITSLPQRHVVPNEGRSVLSGVVIDLDKEGKTKHIERILINDDHPFSTF

SEQ ID NO: 4689 - DNA, 213 bp, Staphylococcus aureus
atgtctattaatattgatccagaaaaatttgcagaattagtggttatgtctaacccatcaaaattcgaagatgcagaggatatagctaaagaaagtttaaagctttacattaatgcatatcgtttagcagagagatattcaacaattgcaacaaattgttatgatactgcagaagttataaaagaattaaagaaaacagatttacaattaaaa

SEQ ID NO: 4690 - protein, 71 aa, Staphylococcus aureus
  MISC_FEATURE (1)..(71): hypothetical protein
MSINIDPEKFAELVVMSNPSKFEDAEDIAKESLKLYINAYRLAERYSTIATNCYDTAEVIKELKKTDLQLK

SEQ ID NO: 4691 - DNA, 1557 bp, Staphylococcus aureus
gtgaatttattaagcctcctactcattttgctggggatcattctaggagttgttggagggtatgttgttgcccgaaatttgttgcttcaaaagcaatcacaagctagacaaactgccgaagatattgtaaatcaagcacataaagaagctgacaatatcaaaaaagagaaattacttgaggcaaaagaagaaaaccaaatcctaagagaacaaactgaagcagaactacgagaaagacgtagcgaacttcaaagacaagaaacccgacttcttcaaaaagaagaaaacttagagcgcaaatctgatctattagataaaaaagatgagattttagagcaaaaagaatcaaaaattgaagaaaaacaacaacaagtagatgcaaaagagagtagtgttcaaacgttaataatgaagcatgaacaagaattagaacgcatctccggtctcactcaagaagaagctattaatgagcaacttcaaagagtagaggaagaactgtcacaagatattgcagtacttgttaaagaaaaagaaaaagaagctaaagaaaaagttgataaaacagcaaaagaattattagctacagcagtacaaagattagcagcagatcacacaagtgaatcaacggtatcagtagttaacttacctaatgatgagatgaaaggtcgaatcattggacgagaaggacgaaacatccgcacacttgaaactttaactggcattgatttaattattgatgacacaccagaagcggttatattatctggttttgatccaataagaagagaaattgctagaacagcacttgttaacttagtatctgatggacgtattcatccaggtagaattgaagatatggtcgaaaaagctagaaaagaagtagacgatattattagagaagcaggtgaacaagctacatttgaagtgaacgcacataatatgcatcctgacttagtaaaaattgtagggcgtttaaactatcgtacgagttacggtcaaaatgtacttaaacattcaattgaagttgcgcatcttgctagtatgttagctgctgagctaggcgaagatgagacattagcgaaacgagctggacttttacatgatgttggtaaagcaattgatcatgaagtagaaggtagtcatgttgaaatcggtgtagaattagcgaaaaaatatggtgaaaatgaaacagttattaatgcaatccattctcatcatggtgatgttgaacctacatctattatatctatccttgttgctgctgcagatgcattgtctgcggctcgtccaggtgcaagaaaagaaacattagagaattatattcgtcgattagaacgtttagaaacgttatcagaaagttatgatggtgtagaaaaagcatttgcgattcaggcaggtagagaaatccgagtgattgtatctcctgaagaaattgatgatttaaaatcttatcgattggctagagatattaaaaatcagattgaagatgaattacaatatcctggtcatatcaaggtgacagttgttcgagagactagagcagtagaatatgcgaaa

SEQ ID NO: 4692 - protein, 519 aa, Staphylococcus aureus
  MISC_FEATURE (1)..(519): conserved hypothetical
VNLLSLLLILLGIILGVVGGYVVARNLLLQKQSQARQTAEDIVNQAHKEADNIKKEKLLEAKEENQILREQTEAELRERRSELQRQETRLLQKEENLERKSDLLDKKDEILEQKESKIEEKQQQVDAKESSVQTLIMKHEQELERISGLTQEEAINEQLQRVEEELSQDIAVLVKEKEKEAKEKVDKTAKELLATAVQRLAADHTSESTVSVVNLPNDEMKGRIIGREGRNIRTLETLTGIDLIIDDTPEAVILSGFDPIRREIARTALVNLVSDGRIHPGRIEDMVEKARKEVDDIIREAGEQATFEVNAHNMHPDLVKIVGRLNYRTSYGQNVLKHSIEVAHLASMLAAELGEDETLAKRAGLLHDVGKAIDHEVEGSHVEIGVELAKKYGENETVINAIHSHHGDVEPTSIISILVAAADALSAARPGARKETLENYIRRLERLETLSESYDGVEKAFAIQAGREIRVIVSPEEIDDLKSYRLARDIKNQIEDELQYPGHIKVTVVRETRAVEYAK

SEQ ID NO: 4693 - DNA, 726 bp, Staphylococcus aureus
atgccagtgattaaaataaacaatcttaataaagtttttggagataatgaagttttaaaagatatcaatcttgaaatcaatcaaggggaagtagtagcaataataggtccatctggtagtggtaaaagtacattgttaagatgtatgaatttattagaagtacctactaaaggtcaagtgatttttgaaggcaatgacttaacggaaaaagggacacaagtagataaactacgtcaaaaaatgggtatggtatttcaaaacttcaacctatttccacataaaaaagttgtcgataatattattttagctcctaaattattaaagaaagataataacgatgaattacataaggaagcattgtcgttattagataaagtgggattaaaagaaaaagcagatgtatatccgaatcaattatcaggtggtcaaaaacaaagggtagcaattgcaagagctttagcaatgcatccagatgttattttattcgatgaaccaacttcagcattagatcctgaggtagttggtgatgtattaaaagtaatgaaagacctagccaaagaaggtatgaccatggtggttgtgacacatgaaatgggatttgccaaagatgtaagtgacaaagtcatatttatggcagatggcgttgtcgtagagtcaggcacaccagtcgaaatatttgaacaaccgcaacatgaaagaacacaaaatttcttagcaagagtatta

SEQ ID NO: 4694 - protein, 242 aa, Staphylococcus aureus
  MISC_FEATURE (1)..(242): glutamate ABC transporter
MPVIKINNLNKVFGDNEVLKDINLEINQGEVVAIIGPSGSGKSTLLRCMNLLEVPTKGQVIFEGNDLTEKGTQVDKLRQKMGMVFQNFNLFPHKKVVDNIILAPKLLKKDNNDELHKEALSLLDKVGLKEKADVYPNQLSGGQKQRVAIARALAMHPDVILFDEPTSALDPEVVGDVLKVMKDLAKEGMTMVVVTHEMGFAKDVSDKVIFMADGVVVESGTPVEIFEQPQHERTQNFLARVL

SEQ ID NO: 4695 - DNA, 1041 bp, Staphylococcus aureus
ttggataacgatcgtcaaaaagctttagatacagtaattaaaaatatggagaaatctttcggtaaaggtgccgtaatgaagttgggtgacaatataggtcgccgagtttcaactacatcaactggttcagttacattagataatgcgctaggtgtaggtggctatcctaaaggacgaattattgaaatttatggtcctgaaagttctggtaagacaacagtagcgcttcacgctattgctgaagtacaaagtaatggcggggtggcagcatttatcgatgctgaacatgctttagatccagaatatgctcaagcattaggcgtagatatcgataatttatatttatcgcaaccggatcatggtgaacaaggtcttgaaatcgccgaagcatttgttagaagtggtgcagttgatattgtagttgtagactcagttgctgctttaacacctaaagctgaaattgaaggagaaatgggagacactcacgttggtttacaagctcgtttaatgtcacaagcgttacgtaaactttcaggtgctatttctaaatcaaatacaactgctattttcatcaaccaaattcgtgaaaaagttggtgttatgttcggtaatccagagactacaccaggtggacgtgcattaaaattctatagttcagtaagactagaagtacgtcgtgcagaacagcttaaacaaggacaagaaattgtaggtaatagaactaaaattaaagtcgttaaaaataaagtggcaccaccatttagagtagctgaagttgatattatgtatggacaaggtatttctaaagagggtgaacttattgatttaggtgttgaaaacgacatcgttgataaatcaggagcatggtattcttacaatggcgaacgaatgggtcaaggtaaggaaaatgttaaaatgtacttgaaagaaaatccacaaattaaagaagaaattgatcgtaaattgagagaaaaattaggtatatctgatggtgatgttgaagaaacagaagatgcaccaaagtcattatttgacgaagaa

SEQ ID NO: 4696 - protein, 347 aa, Staphylococcus aureus
  MISC_FEATURE (1)..(347): RecA protein
LDNDRQKALDTVIKNMEKSFGKGAVMKLGDNIGRRVSTTSTGSVTLDNALGVGGYPKGRIIEIYGPESSGKTTVALHAIAEVQSNGGVAAFIDAEHALDPEYAQALGVDIDNLYLSQPDHGEQGLEIAEAFVRSGAVDIVVVDSVAALTPKAEIEGEMGDTHVGLQARLMSQALRKLSGAISKSNTTAIFINQIREKVGVMFGNPETTPGGRALKFYSSVRLEVRRAEQLKQGQEIVGNRTKIKVVKNKVAPPFRVAEVDIMYGQGISKEGELIDLGVENDIVDKSGAWYSYNGERMGQGKENVKMYLKENPQIKEEIDRKLREKLGISDGDVEETEDAPKSLFDEE

SEQ ID NO: 4697 - DNA, 1149 bp, Staphylococcus aureus
atgtcaattgccattattgctgtaggctcagaactattgctaggtcaaatcgctaataccaacggacaatttctatctaaagtatttaatgaaattggacaaaatgtattagaacataaagttattggagataataaaaaacgtttagaatcaagtgtacgtcatgcgctagaaaaatatgatactgttattttaacaggtggcttaggtcctacgaaagatgacttaacgaagcatacagtggcccagattgttggtaaagatttagttattgatgagccttctttaaaatatattgaaagctattttgaggaacaaggacaagaaatgacacctaataataaacaacaggctttagtaattgaaggttcaactgtattaacaaatcatcatggcatggctccaggaatgatggtgaattttgaaaacaaacaaattattttattaccaggtccaccgaaagaaatgcaaccaatggtgaaaaatgaattgttgtcacattttataaaccataatcgaattatacattctgaactattaagatttgcgggaataggtgaatctaaagtagaaacaatattaatagatcttatcgataaacagactaatcctacgattgcgcctttggcgggaagtcatgaagtatatattagattgactgcaaatgccgactcaaaagaacaagcacaatcattgattcaacctgttaaacaagaaattcttgatcgtattggagaatattattatggttcagatgacacattaattgagcaagctgtaataaagaaaattcatgaaccttttgtaatatatgatggtattactaatggtgctttatatcatcgattgaaagaagtggatttaaacgatgttctaaagggtatgattaatcacaatgaaaactttgttgatattaataaacctattgagcagcaattaaaagatgcagtgcaatttgttaataaattgtttaatgtgtcatcagcaattattctattagagtatgatggtgtagttcatataggctatgataataactttgaatttaaaactgagcaatttaaaatgtctaaatctagaaatttattaaagaacagaagtcaaaattatgcgctcataagattattaaattggcttagaacaacaaat

SEQ ID NO: 4698 - protein, 383 aa, Staphylococcus aureus
  MISC_FEATURE (1)..(383): competence-damage inducible
MSIAIIAVGSELLLGQIANTNGQFLSKVFNEIGQNVLEHKVIGDNKKRLESSVRHALEKYDTVILTGGLGPTKDDLTKHTVAQIVGKDLVIDEPSLKYIESYFEEQGQEMTPNNKQQALVIEGSTVLTNHHGMAPGMMVNFENKQIILLPGPPKEMQPMVKNELLSHFINHNRIIHSELLRFAGIGESKVETILIDLIDKQTNPTIAPLAGSHEVYIRLTANADSKEQAQSLIQPVKQEILDRIGEYYYGSDDTLIEQAVIKKIHEPFVIYDGITNGALYHRLKEVDLNDVLKGMINHNENFVDINKPIEQQLKDAVQFVNKLFNVSSAIILLEYDGVVHIGYDNNFEFKTEQFKMSKSRNLLKNRSQNYALIRLLNWLRTTN

SEQ ID NO: 4699 - DNA, 576 bp, Staphylococcus aureus
atgaatattccgaaccagattacggtttttagagtagtgttaataccagtttttatattgtttgcgttagttgattttggatttggcaatgtgtcatttctaggaggatatgaaataagaattgagttattaatcagtggttttatttttatattggcttcccttagcgattttgttgatggttatttagctagaaaatggaatttagttacaaatatggggaaatttttggatccattagcggataaattattagttgcaagtgctttaattgtacttgtgcaactaggactaacaaattctgtagtagcaatcattattattgccagagaatttgccgtaactggtttacgtttactacaaattgaacaaggattcgtaagtgcagctggtcaattaggtaaaattaaaacagcagttactatggtagcaattacttggttgttattaggtgatccattggcaacattgattggtttgtcattaggacaaattttattatacattggcgttatttttactatcttatctggtattgaatacttttataaaggtagagatgtttttaaacaaaaa

SEQ ID NO: 4700 - protein, 192 aa, Staphylococcus aureus [sequence omitted]

SEQ ID NO: 4701 - DNA, 390 bp, Staphylococcus aureus
ttgaaaacggtcggtgaagcgctaaaaggtagacgtgaaaggttaggaatgactttaacagaattagagcaacgtactggaattaaacgtgaaatgctagtgcatattgaaaataatgaattcgatcaactaccgaataaaaattacagcgaaggatttattagaaaatatgcaagcgtagtaaatattgaacctaaccaattaattcaagctcatcaagatgaaattccatcgaaccaagccgaatgggacgaagtaattacagttttcaataataataaagacttagattataagagtaaatcaaaagagccaatacaattattagtaatcatgggtattacagttttaataactttattgttatggatcatgttagttttaatattt

SEQ ID NO: 4702 - protein, 130 aa, Staphylococcus aureus
  MISC_FEATURE (1)..(130): conserved hypothetical
LKTVGEALKGRRERLGMTLTELEQRTGIKREMLVHIENNEFDQLPNKNYSEGFIRKYASVVNIEPNQLIQAHQDEIPSNQAEWDEVITVFNNNKDLDYKSKSKEPIQLLVIMGITVLITLLLWIMLVLIF

SEQ ID NO: 4703 - DNA, 879 bp, Staphylococcus aureus
atgaatattacaatgaatcataatttgttaattaaacaaggggtgaggttcaccatgacagttgcagagaaaaaagaatggtacctagaatacgaaattgaaattaatagaccgggtcttttaggtgatgtatctagtttattaggtatgttaggtataagtattgttacaattaatggtgttgatcaaggtaaacgaggccttttaattaaaacagacaatcttgaaaaagttgaacgttttgagcaaatagctcgtggtataaatgaaattgaaataacaaagcttaaaaaaccagaattaagagaccgtcttgcagtaagacatggaagatatattgagcaagatgcaaaagataagaaaacctttcgatttgagcgtgaagatttaggcttgttagtagactttttagctgaattgttcaaagaagaaggtcataagttgattggcattagaggtatgccacgggttggtaaaactgaatcaattgttgcgggaagtgtttgtgcacataagagatggttatttattagttctactttaataaaacaaactgtacgtagctctctaattaaaggggaatatgatgccaatcatgtatacattattgatggtgcagttactgccagagaatctaatccaaaacatcaagagcttgttaacgaagttatgacgttaccatcaatcaaagtcgttgaacatccagatttatttgttgaaacaagtacttgtacaatggaagattttgactatattatcgaattgagagaaaatgaaaatcaagaaatacattacgaagaaatgaagaaacagacagtccaaagtaagaataatttagattttggagatccgtttggtggtggttttggtttcttcgag

SEQ ID NO: 4704 - protein, 293 aa, Staphylococcus aureus
  MISC_FEATURE (1)..(293): conserved hypothetical
MNITMNHNLLIKQGVRFTMTVAEKKEWYLEYEIEINRPGLLGDVSSLLGMLGISIVTINGVDQGKRGLLIKTDNLEKVERFEQIARGINEIEITKLKKPELRDRLAVRHGRYIEQDAKDKKTFRFEREDLGLLVDFLAELFKEEGHKLIGIRGMPRVGKTESIVAGSVCAHKRWLFISSTLIKQTVRSSLIKGEYDANHVYIIDGAVTARESNPKHQELVNEVMTLPSIKVVEHPDLFVETSTCTMEDFDYIIELRENENQEIHYEEMKKQTVQSKNNLDFGDPFGGGFGFFE

SEQ ID NO: 4705 - DNA, 702 bp, Staphylococcus aureus
atgaaagcattagtattaggtggttctggttcaattggttctgagatagtcaaacaattattaactgatggatttgaagtttatgtgcaatattatcgtactgatataaatgaattaactagcaaatttaatgatgataaagttcgttttatacaagcggatttatctcaaacaattgatattgacaaaacatttggtgacattaaatcattagactgtttaatatatgcaagtggtcagtctttatatggtgttttacaagatatgaaagaccatgatattgatgcatgttatcagttaaatgtcttgcaattaattcgattatgtagatatttcgttgatgttttacgtcaaagtgccaatggaagaattattgtaatttcatcaatttggggtgagacaggagctagtatggaaactatttattcggcgatgaaaagtgcacaattaggtttcgttaaggcgcttagtcaagagcttgcactaacatcagtgacagtaaatgctatcgcacctggatttgtagccggtaatatggcaagtgagtggcaagaagatgaacttcaagcaatgataactgaattaccacaacagcgattggttttaccgagtgaggttgctcatacatgcgcctatttatatcacccaaatgctagaagtgttactggaactatacagaaagttaatggtgcttggtatatt

SEQ ID NO: 4706 - protein, 234 aa, Staphylococcus aureus
  MISC_FEATURE (1)..(234): hypothetical protein
MKALVLGGSGSIGSEIVKQLLTDGFEVYVQYYRTDINELTSKFNDDKVRFIQADLSQTIDIDKTFGDIKSLDCLIYASGQSLYGVLQDMKDHDIDACYQLNVLQLIRLCRYFVDVLRQSANGRIIVISSIWGETGASMETIYSAMKSAQLGFVKALSQELALTSVTVNAIAPGFVAGNMASEWQEDELQAMITELPQQRLVLPSEVAHTCAYLYHPNARSVTGTIQKVNGAWYI

SEQ ID NO: 4707 - DNA, 1284 bp, Staphylococcus aureus
atgaaagagcgttattatgaattaatagacgaaagagtattcgaacaagaattagaaaatggtttacgattatttattatccccaaaccaggttttcaaaagacatttgtcacttacactacacaatttggttcattagataatcaattcaaaccccttggacaagaccaatttgttactgtacctgatggagttgctcactttttagaacataaattatttgaaaaagaagaagaagacttatttactgcgtttgctgaagataacgcacaagcaaatgcgtttacaagctttgatcgtacaagctacttgttcagtgcaactgataatattgaaaacaacattaaacgtttacttacaatggttgaaacgccttattttacaaaagaaactgttgataaagaaaaaggtattattgcagaagaaataaaaatgtatcaagagcaacctggatataaattaatgtttaatacattgcgtgcaatgtatcaacaacatccaatacgtgttgatattgccggtagtgtagaaagtatatacgatattacaaaagatgatttgtatctatgttatgaaacgttttatcatccatcaaatatggttttatttgttgttggcgatgtggatcctgaagcaatatgtcgaatagtaaaacaacacgaggatgctcgtaataaagttaaccaacccaaaatcgaacgaggacttgttgatgaaccggaggatgttaaagaagcatttgttactgaatctatgaaaattcaatcaccaagactaatgcttggttttaaaaataaaccattacaagaagcgcctcaaaaatatgtacaacgtgatttagaaatgtcattattctttgagttaatttttggggaagaaacagatttttatcagaatttattaaacgaaggacttatcgatgatacatttggttatcaatttgtactagagccgacgtatagtttttcaatcgtgacaagtgctactgaagaaccagataaattaaaaaaattattattagatgagttgcgtgataaaaaaggcaatttccaagatgcagaagcatttgaacttttgaaaaagcaatttataggtgaattcatatcaagtttaaactcacctgaatatattgctaatcaatatactaaattgtattttgaaggtgttagcgtgtttgacatgttagacattgttgaaaatatcacgttagatagtattaacgaaacgtcatcgttatatttaaatttagatcagcaagtcgatagtcgtttggagattaaaaag

SEQ ID NO: 4708 - protein, 428 aa, Staphylococcus aureus
  MISC_FEATURE (1)..(428): hypothetical protein
MKERYYELIDERVFEQELENGLRLFIIPKPGFQKTFVTYTTQFGSLDNQFKPLGQDQFVTVPDGVAHFLEHKLFEKEEEDLFTAFAEDNAQANAFTSFDRTSYLFSATDNIENNIKRLLTMVETPYFTKETVDKEKGIIAEEIKMYQEQPGYKLMFNTLRAMYQQHPIRVDIAGSVESIYDITKDDLYLCYETFYHPSNMVLFVVGDVDPEAICRIVKQHEDARNKVNQPKIERGLVDEPEDVKEAFVTESMKIQSPRLMLGFKNKPLQEAPQKYVQRDLEMSLFFELIFGEETDFYQNLLNEGLIDDTFGYQFVLEPTYSFSIVTSATEEPDKLKKLLLDELRDKKGNFQDAEAFELLKKQFIGEFISSLNSPEYIANQYTKLYFEGVSVFDMLDIVENITLDSINETSSLYLNLDQQVDSRLEIKK

SEQ ID NO: 4709 - DNA, 1263 bp, Staphylococcus aureus
ttgagtagacaatctcaaccaaatatacatatcaaagtttcaccaacaactaaatttaaaacaactactatagtttttaaatttatggcacctttagaatatgacacaataacagctagatcattattaagcaaattattagttcgagcaactaagaaatggccaaccgataagtcgtttaataatcacttagccgatttatatggtgcgtatgtgaatagtacaatttcaaaattcaaagatcagcatgtcattacattttcattagaaattgttaatgaacgttatttaagaaacggtgaatcattatttaatcaaggattagatttattacaagaaatcatttggaatccattaattgaaaataaagcattcaatgataattttgttaaccaagagaaaacattattagccaaaaaaatagaagcaatggtagataataaagcacaatattcgtttttaaaattactcgaccatatgtttgaaaatgaagcatataaatacttatctacaggacaactagaacaaatcccacatattactgctgaaacactatatcatacatatcaatcaatgattaataatgatcaatgttctgtttatgttgtcggcaatgtagaacctgaaagtgttgagaaacaaatacgtgaaaaatttgcacttaaaccattcgataaacatcaattccaacattctactcatcatttacacgatgaagaagttgattatattgttgaatatgatgacgtggatcaagctaaattaaatatgggataccgttttccaacacaatatggacaaagtggatatgctgcctttgttgtatttaacatgatgtttggaggagatccttcatctgttttatttaatgaagtgcgagaaaagcaaagtttagcgtactctatacattcacaaattgatggcaaaaatggctatttatttgttttgagtggggtttcaagtgataagtacgaaactgcaaaagacactattataagtgaatttgaaaaaataaaagcaggagatttcactgaagaaaaattagagttagctaaaaaagtaatcatttctcatcgatatgaatctgaagatcgtccgaaaagtattatagagattatgcataaccaaatattattagagcaaccacaaagcaaagaaacatttataaatgatatacagaaggtaagtcgcgaagatattgtttctgttgctgaaaaagcatttttagatacaatctatgtgttgacaaaaggaggggataaa

SEQ ID NO: 4710 - protein, 421 aa, Staphylococcus aureus
  MISC_FEATURE (1)..(421): hypothetical protein
LSRQSQPNIHIKVSPTTKFKTTTIVFKFMAPLEYDTITARSLLSKLLVRATKKWPTDKSFNNHLADLYGAYVNSTISKFKDQHVITFSLEIVNERYLRNGESLFNQGLDLLQEIIWNPLIENKAFNDNFVNQEKTLLAKKIEAMVDNKAQYSFLKLLDHMFENEAYKYLSTGQLEQIPHITAETLYHTYQSMINNDQCSVYVVGNVEPESVEKQIREKFALKPFDKHQFQHSTHHLHDEEVDYIVEYDDVDQAKLNMGYRFPTQYGQSGYAAFVVFNMMFGGDPSSVLFNEVREKQSLAYSIHSQIDGKNGYLFVLSGVSSDKYETAKDTIISEFEKIKAGDFTEEKLELAKKVIISHRYESEDRPKSIIEIMHNQILLEQPQSKETFINDIQKVSREDIVSVAEKAFLDTIYVLTKGGDK

SEQ ID NO: 4711 - DNA, 729 bp, Staphylococcus aureus
atgacgaggtgtaaaaaaatgtcagaaatgaatgcggtatataacgttaaacaatacattttaaatttgattaagcaaaataaattggaatatggtgaccaacttccaagtaatttatcaattgccagagaattaaatgtaaaaaccgacgatgtttatgaagcaattcaggcattgattactgaacaagtcattaaagataattttgaagagggcacaagtgttaagtcactgccccctttcttttatccattgaatgaacttataagtattgggcaaatgattaaaaatgcaggatttgaatgcggaactgaatacttaaattttgatgagcaaccagcaactatgttagatgcaaatttgttgagcgttgaagaaggatatccagtaaccattatagaacgattacgaactgccgatggagaaccggtcgtctattgtttagataaaattgctaaaaaagaattaacatgtacagagtatcaaatgagcaatggatcgattctaagtgcgataaaagaacaaagtaatcataatatttgttatgctgatacagaaattgaagcggtaaattatgaacctcgaatatccgaagtactgaatgcttcgccacacgaaggtttgattttattaaaaattacgcactataatgaatcagatgaacctattttgtattcattaaattatatgaaaaatagcttagttcaatttaaaatcactagaaaaata

SEQ ID NO: 4712 - protein, 243 aa, Staphylococcus aureus
  MISC_FEATURE (1)..(243): hypothetical protein
MTRCKKMSEMNAVYNVKQYILNLIKQNKLEYGDQLPSNLSIARELNVKTDDVYEAIQALITEQVIKDNFEEGTSVKSLPPFFYPLNELISIGQMIKNAGFECGTEYLNFDEQPATMLDANLLSVEEGYPVTIIERLRTADGEPVVYCLDKIAKKELTCTEYQMSNGSILSAIKEQSNHNICYADTEIEAVNYEPRISEVLNASPHEGLILLKITHYNESDEPILYSLNYMKNSLVQFKITRKI

SEQ ID NO: 4713 - DNA, 2376 bp, Staphylococcus aureus
gtgcgtcaattggcacaagcaaaaaagaaatcgacagctaagaaaaaaacaacatcaaaaaaaagaacaaattcgaggaaaaagaagaatgataatccgatacgttatgtcatagctattttagtagttgtattaatggtgttgggtgttttccaattaggaataataggtcgtctaattgacagcttctttaattatttatttgggtacagtagatatttaacatatattttagtactcttagcaactggttttattacatactctaaacgtattcctaaaactagacgaacggctggttcgattgtattgcaaattgcattgctatttgtatcacagttagtttttcattttaatagtggtatcaaagctgaaagagaacctgtactttcttatgtgtatcagtcataccaacacagtcatttcccaaattttggtggcggtgtattaggcttttatttattagagttaagcgtacctttaatttcattatttggtgtatgtattattactattttattattatgctcaagtgttattttattaacaaaccatcaacatcgtgaagttgcaaaagttgcactggaaaatataaaagcttggtttggttcatttaatgaaaaaatgtcggaaagaaaccaagaaaaacaattgaagcgtgaagaaaaagcaagacttaaagaagaacaaaaggcacgtcaaaatgaacagccacaaataaaagatgtgagtgattttacggaagtgcctcaagaaagagatattccaatttatgggcatactgaaaatgaaagtaaaagccagagtcaaccaagtcgaaaaaaacgagtgtttgatgcagagaatagttcgaataacatcgtaaatcatcatcaagcagatcagcaagaacaattaacagaacaaactcataacagtgttgaaagtgaaaacactattgaagaagctggtgaagttacgaatgtatcgtatgttgttccaccgttaactttacttaatcaacctgcaaaacaaaaagcaacatctaaagctgaagtgcaacgtaaaggacaagtactagagaatacattaaaagattttggggtaaatgcaaaagtgacacaaattaaaattggtcctgcagtaactcaatatgaaattcaaccagctcaaggggttaaagtgagtaaaattgtaaacttgcataatgatattgcattagctttagcagcaaaagatgttagaatcgaagcgccaatacctggtcgttctgcagtaggtattgaagtgccaaatgagaaaatttcattagtttcactaaaagaagttttagatgaaaaattcccgtctaataataaactagaagttggattaggaagagatatatcaggtgatccaattactgttccactaaatgaaatgccacacttattggtggcaggatcgacgggtagtggtaaatctgtttgtataaatggtattattacaagtattttattaaatgctaagccgcatgaagttaaacttatgttaatcgatccgaaaatggttgaactaaatgtttataacggaattccacacttattaattccggttgttacaaatcctcataaagctgctcaagctttagaaaaaattgtagctgagatggaaagacgttatgatttattccaacattcatcaactagaaacattaaaggttataacgaattaatccgtaagcaaaatcaagaattagatgagaagcaaccagaattaccttatatcgttgttattgtagatgagcttgcagatttaatgatggtagctggtaaagaagttgaaaatgcgattcaacgtattacacaaatggcacgtgcagcaggtatacatttaattgtagcgacacaaagaccttctgtggatgtaattacaggtatcattaaaaataatattccatctagaatagcttttgctgtgagttctcaaacagattcaagaactattattggtactggcggcgcagaaaagttacttggtaaaggtgacatgttatacgttggaaatggtgactcatcacaaacacgtattcaaggggcgtttttaagtgaccaagaggtgcaagatgttgtaaattatgtagtagaacaacaacaggcaaattatgtaaaagaaatggaaccagatgcaccagtggataaatcggaaatgaaaagtgaagatgctttatatgatgaagcgtatttgtttgttgttgaacaacaaaaggcaagtacatcattgttacaacgccaatttagaattggttataatagagcatctaggttgatggatgatttagaacgcaatcaggtaatcggtccacaaaaaggaagcaagcctagacaagttttaatagatcttaataatgacgaggtg

SEQ ID NO: 4714 - protein, 792 aa, Staphylococcus aureus
  MISC_FEATURE (1)..(792): sporulation-related protein
VRQLAQAKKKSTAKKKTTSKKRTNSRKKKNDNPIRYVIAILVVVLMVLGVFQLGIIGRLIDSFFNYLFGYSRYLTYILVLLATGFITYSKRIPKTRRTAGSIVLQIALLFVSQLVFHFNSGIKAEREPVLSYVYQSYQHSHFPNFGGGVLGFYLLELSVPLISLFGVCIITILLLCSSVILLTNHQHREVAKVALENIKAWFGSFNEKMSERNQEKQLKREEKARLKEEQKARQNEQPQIKDVSDFTEVPQERDIPIYGHTENESKSQSQPSRKKRVFDAENSSNNIVNHHQADQQEQLTEQTHNSVESENTIEEAGEVTNVSYVVPPLTLLNQPAKQKATSKAEVQRKGQVLENTLKDFGVNAKVTQIKIGPAVTQYEIQPAQGVKVSKIVNLHNDIALALAAKDVRIEAPIPGRSAVGIEVPNEKISLVSLKEVLDEKFPSNNKLEVGLGRDISGDPITVPLNEMPHLLVAGSTGSGKSVCINGIITSILLNAKPHEVKLMLIDPKMVELNVYNGIPHLLIPVVTNPHKAAQALEKIVAEMERRYDLFQHSSTRNIKGYNELIRKQNQELDEKQPELPYIVVIVDELADLMMVAGKEVENAIQRITQMARAAGIHLIVATQRPSVDVITGIIKNNIPSRIAFAVSSQTDSRTIIGTGGAEKLLGKGDMLYVGNGDSSQTRIQGAFLSDQEVQDVVNYVVEQQQANYVKEMEPDAPVDKSEMKSEDALYDEAYLFVVEQQKASTSLLQRQFRIGYNRASRLMDDLERNQVIGPQKGSKPRQVLIDLNNDEV

SEQ ID NO: 4715 - DNA, 1404 bp, Staphylococcus aureus
gtgctatggtgtatatcaatcccacagcacatgctgaacaagatcaactgggagaagattaaagaacgcggtgaacttagagtgggtctttctgcagattatgcaccaatggaatttgagcatacagttaatggtaagactgagtatgcaggtgtagatattgatttagctaaaaaaattgcgaaagataataatttaaaattaaaaatcgtcaatatgtcatttgatagtttgttaggagctcttaaaactggaaaaattgatattattatttccggaatgacttcaacgcctgaacgtaagaagcaagttgatttttcagattcatatatgatgactaaaaatatcatgcttgtaaagaaagataaagttaatgaatataaagatatcaaagactttaataataaaaaagtaggggcacaaaagggaactgaacaagaaaaaatcgctcaaaccgaaattgaaaatgcatctattacttcattaagccgtttaccagacgttatattagcattgaaaagtggaaaggttgaaggtgctgtagttgaaaaacctgtagcagaagcatatttaaaacaaaatcctaaattaggaatttccaatgtgaaatttaatgaagaagaaaaagatacagtgatagcagtgccaaaagattcaccaaaattattgtcacaaattaataaaacgattaaggaggttaaagataaaggattaatcgataaatatatgactaatgctgcaaatgcgatgaatgatgacagtggttttatttctaagtatggtagttttttcttgaaaggaattaagattacaatattaatttcacttatcggtgttgcattaggttctattttaggtgcattcgttgcgttaatgaaattaagtaaaataaaaattatttcatggattgcttctatctatatcgaaatattaagaggaacaccaatgttagttcaagtatttatcgtattctttggtataactgctgcattaggactagacatttcagctcttgtttgtggaacaattgcattagttattaattcctcagcttacattgctgaaattattcgtgcaggtataaatgctgttgataaaggccaaatggaagccgcacgtagtctaggtttgaattatagacaaacgatgaaaagtgtaattatgccacaagcaattaaaaatattttaccagctttaggtaatgaatttgtcactttaattaaagaatcatctattgtgtcaacaattggagttggcgaaattatgtttaatgcacaagtggttcaaggtatttcatttgacccattcacaccattaatagtggcagcagcattatactttgtcttaacatttgtacttacacgcattatgaacatgattgaagggagattgaatgccagtgat

SEQ ID NO: 4716 - protein, 468 aa, Staphylococcus aureus
  MISC_FEATURE (1)..(468): hypothetical protein
VLWCISIPQHMLNKINWEKIKERGELRVGLSADYAPMEFEHTVNGKTEYAGVDIDLAKKIAKDNNLKLKIVNMSFDSLLGALKTGKIDIIISGMTSTPERKKQVDFSDSYMMTKNIMLVKKDKVNEYKDIKDFNNKKVGAQKGTEQEKIAQTEIENASITSLSRLPDVILALKSGKVEGAVVEKPVAEAYLKQNPKLGISNVKFNEEEKDTVIAVPKDSPKLLSQINKTIKEVKDKGLIDKYMTNAANAMNDDSGFISKYGSFFLKGIKITILISLIGVALGSILGAFVALMKLSKIKIISWIASIYIEILRGTPMLVQVFIVFFGITAALGLDISALVCGTIALVINSSAYIAEIIRAGINAVDKGQMEAARSLGLNYRQTMKSVIMPQAIKNILPALGNEFVTLIKESSIVSTIGVGEIMFNAQVVQGISFDPFTPLIVAAALYFVLTFVLTRIMNMIEGRLNASD

SEQ ID NO: 4717 - DNA, 1722 bp, Staphylococcus aureus
atgaatagtgagtttatatatggacgggtaacaaatttaggaggtaagattttgagtttaataaagaaaaagaataaagatattcgcattataccattaggcggtgttggcgaaattgctaaaaatatgtatatcgttgaagtagacgatgaaatgtttatgttagatgctggacttatgtttccagaagacgaaatgctaggtattgatattgttataccagacatttcatacgtacttgaaaataaagataaattgaagggtatattccttacacacggacatgagcacgcgattggtgcagtgagttatgttttagaacaattagatgcaccagtatatggatctaaattgacaatagcgttaattaaagaaaatatgaaagcccgtaatattgataaaaaagttcgctactatacagttaataatgattcaattatgagattcaaaaacgtgaatattagtttctttaatacgacacacagtattcctgatagtttaggtgtttgtattcacacttcatatggtgccattgtgtatacaggtgaatttaagtttgaccaaagtttacatggacattatgcaccagatattaaacgtatggcagagattggtgaagaaggcgtatttgtcttaatcagtgattctactgaggcagagaaacctggatataatactccggaaaatgtgattgaacatcatatgtatgatgcttttgcaaaagtgcgaggtcgcttgatagtttcatgttatgcttcgaactttatacgtattcagcaagttttaaatattgctagcaagctaaatcgtaaagtgtcatttttaggaagatcacttgaaagttcatttaatattgctcgtaaaatggggtatttcgacattcctaaagatttgctaattcctataacagaagttgataattatcctaaaaatgaagtgataattatagctactggtatgcaaggagaacctgtagaagccttaagtcaaatggcgcaacataagcataaaattatgaatatcgaagaaggcgattctgtatttttagcaattacggcttctgctaatatggaagttatcattgcgaatacattaaatgagcttgtacgtgctggcgcacatattattccaaataacaaaaagattcatgcttcaagtcatggttgcatggaagaattaaaaatgatgattaatattatgaaacctgaatactttattcctgtacaaggtgaatttaaaatgcagatagcacatgcgaagctagcagctgaagcaggtgttgcaccagaaaagattttccttgtggaaaaaggagatgtcattaattacaacggtaaagatatgatattaaatgaaaaggtaaattcaggaaatattttaatagatggcattggtattggggatgtaggaaatatcgtgttgagagaccgtcatcttttagcagaagatggtatctttattgctgttgtaacgttagatcctaaaaatagacgtatagctgcgggacctgaaattcaatctcgtgggtttgtatatgtacgtgaaagtgaagacttattacgtgaagcagaagagaaagtacgtgaaatagtagaggctggtttacaagaaaaacgcatagaatggtctgaaattaaacaaaatatgcgtgatcaaattagtaaactattattcgaaagtacaaaacgtcgtcctatgattattccagtaatttctgaaatt

SEQ ID NO: 4718 - protein, 574 aa, Staphylococcus aureus
  MISC_FEATURE (1)..(574): conserved hypothetical
MNSEFIYGRVTNLGGKILSLIKKKNKDIRIIPLGGVGEIAKNMYIVEVDDEMFMLDAGLMFPEDEMLGIDIVIPDISYVLENKDKLKGIFLTHGHEHAIGAVSYVLEQLDAPVYGSKLTIALIKENMKARNIDKKVRYYTVNNDSIMRFKNVNISFFNTTHSIPDSLGVCIHTSYGAIVYTGEFKFDQSLHGHYAPDIKRMAEIGEEGVFVLISDSTEAEKPGYNTPENVIEHHMYDAFAKVRGRLIVSCYASNFIRIQQVLNIASKLNRKVSFLGRSLESSFNIARKMGYFDIPKDLLIPITEVDNYPKNEVIIIATGMQGEPVEALSQMAQHKHKIMNIEEGDSVFLAITASANMEVIIANTLNELVRAGAHIIPNNKKIHASSHGCMEELKMMINIMKPEYFIPVQGEFKMQIAHAKLAAEAGVAPEKIFLVEKGDVINYNGKDMILNEKVNSGNILIDGIGIGDVGNIVLRDRHLLAEDGIFIAVVTLDPKNRRIAAGPEIQSRGFVYVRESEDLLREAEEKVREIVEAGLQEKRIEWSEIKQNMRDQISKLLFESTKRRPMIIPVISEI

SEQ ID NO: 4719 - DNA, 2094 bp, Staphylococcus aureus
atgtctcaagaaaagaaagtttttaaaactgaatgggcaggaagatctttaacgattgaaacagggcaattagctaaacaagcaaatggcgctgtattggttcgttatggagatacagtcgtgttatcgacggcaactgcatcaaaagaacctcgtgatggagatttcttcccattaacagtgaactatgaagaaaaaatgtacgctgcgggtaaaattcctggtggatttaaaaagagagaaggacgtcctggtgacgatgcaacattaactgcgcgattaattgatagaccaattagacctttattccctaaaggatataagcatgatgttcaaattatgaacatggtattaagtgcagatcctgattgttcaccacaaatggctgcaatgattggttcatctatggcgcttagtgtgtcggatattccattccaagggccaatcgccggtgtaaatgtgggttatattgacggtaaatatatcattaacccaacagtagaagaaaaagaagtttctcgtttagaccttgaagtagctggtcataaagatgcggtaaacatggtagaggcaggcgctagtgagattactgaacaagaaatgttagaggcgattttctttggtcatgaagagattcaacgtttagttgatttccaacaacaaatcgtcgaccacattcaacctgttaaacaagaatttattccagcagagcgtgatgaagcgctagttgaacgtgtaaaatctttaaccgaagaaaaaggacttaaagaaacagttttaacatttgataaacaacaacgagatgaaaatcttgataacttaaaagaagaaatcgtcaatgaatttatcgatgaagaagatccagagaatgaattacttattaaagaagtttatgcaattttaaatgaattagtgaaagaagaagttcgacgtttaattgcagatgaaaaaattagaccagacggccgtaaacctgatgaaatccgtccattagattctgaagttggtattttacctagaacgcatggttcaggtctatttacacgtggtcagactcaagcactttcagttttaacattaggtgctttaggcgattatcaattaattgatggtttaggacctgaagaagaaaaaagattcatgcatcattacaacttcccgaatttttcagtaggtgaaactggtccagtacgtgcgccaggtcgtcgtgaaattggacatggtgcgttaggtgaaagagcattaaaatatattattcctgatactgctgatttcccatatacaattcgtattgtaagtgaggtacttgaatcaaatggttcatcatctcaagcgtcaatttgtggatcaacattagcattaatggatgcgggcgtaccgattaaagcaccagttgctggtattgctatgggccttgttacacgtgaagatagctatacgattttaactgatatccaaggtatggaagatgcattaggtgatatggactttaaagtcgctggtactaaagaaggtattacagcaatccaaatggatattaaaattgacggtttaacgcgtgaaattatcgaagaggctctagaacaagcgagacgtggtcgtttagaaataatgaatcatatgttacaaacaattgatcaaccacgtactgaattaagtgcttacgcgccaaaagttgtaactatgacaattaaaccagataagattagagatgttatcggacctggtggtaaaaaaattaacgaaattattgatgaaacaggtgttaaattagatattgaacaagatggtactatctttattggtgctgttgatcaagctatgataaatcgtgctcgtgaaatcattgaggaaattacacgtgaagcggaagtaggtcaaacttatcaagccactgttaaacgtattgaaaaatacggtgcgtttgtaggcctattcccaggtaaagatgcgttgcttcacatttcacaaatttcaaaaaatagaattgaaaaagtggaagatgtattaaaaatcggtgacacaattgaagttaagattactgaaattgataaacaaggtcgagtaaatgcttcacatagagcattagaagaa

SEQ ID NO: 4720 - protein, 698 aa, Staphylococcus aureus
  MISC_FEATURE (1)..(698): polyribonucleotide
MSQEKKVFKTEWAGRSLTIETGQLAKQANGAVLVRYGDTVVLSTATASKEPRDGDFFPLTVNYEEKMYAAGKIPGGFKKREGRPGDDATLTARLIDRPIRPLFPKGYKHDVQIMNMVLSADPDCSPQMAAMIGSSMALSVSDIPFQGPIAGVNVGYIDGKYIINPTVEEKEVSRLDLEVAGHKDAVNMVEAGASEITEQEMLEAIFFGHEEIQRLVDFQQQIVDHIQPVKQEFIPAERDEALVERVKSLTEEKGLKETVLTFDKQQRDENLDNLKEEIVNEFIDEEDPENELLIKEVYAILNELVKEEVRRLIADEKIRPDGRKPDEIRPLDSEVGILPRTHGSGLFTRGQTQALSVLTLGALGDYQLIDGLGPEEEKRFMHHYNFPNFSVGETGPVRAPGRREIGHGALGERALKYIIPDTADFPYTIRIVSEVLESNGSSSQASICGSTLALMDAGVPIKAPVAGIAMGLVTREDSYTILTDIQGMEDALGDMDFKVAGTKEGITAIQMDIKIDGLTREIIEEALEQARRGRLEIMNHMLQTIDQPRTELSAYAPKVVTMTIKPDKIRDVIGPGGKKINEIIDETGVKLDIEQDGTIFIGAVDQAMINRAREIIEEITREAEVGQTYQATVKRIEKYGAFVGLFPGKDALLHISQISKNRIEKVEDVLKIGDTIEVKITEIDKQGRVNASHRALEE

SEQ ID NO: 4721 - DNA, 273 bp, Staphylococcus aureus
ttgattatggcaatttcacaagaacgtaaaaacgaaatcattaaagaataccgtgtacacgaaactgatactggttcaccagaagtacaaatcgctgtacttactgcagaaatcaacgcagtaaacgaacacttacgtacacacaaaaaagaccaccattcacgtcgtggattattaaaaatggtaggtcgtcgtagacatttattaaactacttacgtagtaaagatattcaacgttaccgtgaattaattaaatcacttggtatccgtcgt

SEQ ID NO: 4722 - protein, 91 aa, Staphylococcus aureus
  MISC_FEATURE (1)..(91): 30Sribosomal protein S15
LIMAISQERKNEIIKEYRVHETDTGSPEVQIAVLTAEINAVNEHLRTHKKDHHSRRGLLKMVGRRRHLLNYLRSKDIQRYRELIKSLGIRR

SEQ ID NO: 4723 - DNA, 969 bp, Staphylococcus aureus
atgaaagtcatagaagtgacacatcctatacaatctaaacagtatattacagaggatgttgcaatggcattcggatttttcgatggcatgcataaaggtcatgacaaagtctttgatatattaaacgaaatagctgaggcacgcagtttaaaaaaagcggtgatgacatttgatccgcatccgtctgtcgtgttgaatcctaaaagaaaacgaacaacgtatttaacgccactttcagataaaatcgaaaaaattagccaacatgatattgattattgtatagtggttaatttttcatctaggtttgctaatgtgagcgtagaagattttgttgaaaattatataattaaaaataatgtaaaagaagtcattgctggttttgattttacttttggtaaatttggaaaaggtaatatgactgtacttcaagaatatgatgcgtttaatacgacaattgtgagtaaacaagaaattgaaaatgaaaaaatttctacaacttctattcgtcaagatttaatcaatggtgagttgcaaaaagcgaatgatgctttaggctatatatattctattaaaggcactgtagtgcaaggtgaaaaaaggggaagaactattggcttcccaacagctaacattcaacctagtgatgattatttgttacctcgtaaaggtgtttatgctgttagtattgaaatcggcactgaaaataaattatatcgaggggtagctaacataggtgtaaagccaacatttcatgatcctaacaaagcagaagttgtcatcgaagtgaatatctttgactttgaggataatatttatggtgaacgagtgaccgtgaattggcatcatttcttacgtcctgagattaaatttgatggtatcgacccattagttaaacaaatgaacgatgataaatcgcgtgctaaatatttattagcagttgattttggtgatgaagtagcttataatatc

SEQ ID NO: 4724 - protein, 323 aa, Staphylococcus aureus
  MISC_FEATURE (1)..(323): riboflavin kinase / FAD
MKVIEVTHPIQSKQYITEDVAMAFGFFDGMHKGHDKVFDILNEIAEARSLKKAVMTFDPHPSVVLNPKRKRTTYLTPLSDKIEKISQHDIDYCIVVNFSSRFANVSVEDFVENYIIKNNVKEVIAGFDFTFGKFGKGNMTVLQEYDAFNTTIVSKQEIENEKISTTSIRQDLINGELQKANDALGYIYSIKGTVVQGEKRGRTIGFPTANIQPSDDYLLPRKGVYAVSIEIGTENKLYRGVANIGVKPTFHDPNKAEVVIEVNIFDFEDNIYGERVTVNWHHFLRPEIKFDGIDPLVKQMNDDKSRAKYLLAVDFGDEVAYNI

SEQ ID NO: 4725 - DNA, 657 bp, Staphylococcus aureus
ttggaaacaaaaggtgtacactcagcagattttaataaggacgatattgaccgattgttagaaagttttaaaggtatcattgaacaaattccgccgatgtactcatccgtcaaagtaaatggtaaaaaattatatgaatatgcgcgtaataatgaaacagttgaaagaccaaagcgtaaagttaatattaaagacattgggcgtatatctgaattagattttaaagaaaatgagtgtcattttaaaatacgcgtcatctgtggtaaaggtacatatattagaacgctagcaactgatattggtgtgaaattaggctttccggcacatatgtcgaaattaacacgaatcgagtctggtggatttgtgttgaaagatagccttacattagaacaaataaaagaacttcatgagcaggattcattgcaaaataaattgtttcctttagaatatggattaaagggtttgccaagcattaaaattaaagattcgcacataaaaaaacgtattttaaatgggcagaaatttaataaaaatgaatttgataacaaaattaaagaccaaattgtatttattgatgatgattcagaaaaagtattagcaatttatatggtacaccctacaaaagaatcagaaattaaacctaaaaaagtctttaat

SEQ ID NO: 4726 - protein, 219 aa, Staphylococcus aureus
  MISC_FEATURE (1)..(219): tRNA pseudouridine 5S
LETKGVHSADFNKDDIDRLLESFKGIIEQIPPMYSSVKVNGKKLYEYARNNETVERPKRKVNIKDIGRISELDFKENECHFKIRVICGKGTYIRTLATDIGVKLGFPAHMSKLTRIESGGFVLKDSLTLEQIKELHEQDSLQNKLFPLEYGLKGLPSIKIKDSHIKKRILNGQKFNKNEFDNKIKDQIVFIDDDSEKVLAIYMVHPTKESEIKPKKVFN

SEQ ID NO: 4727 - DNA, 237 bp, Staphylococcus aureus
atgtataatgggatattaccagtatataaagagcgcggtttaacaagtcatgacgttgtattcaaattgcgtaaaatattaaaaactaaaaaaataggtcacacgggtacgcttgatcccgaagttgcaggcgtgttaccggtatgtataggtaatgcaacgagagttagtgattatgttatggatatgggcaaagcttatgaagcaactgtatcgataggaagaagtacaaccgac

SEQ ID NO: 4728 - protein, 79 aa, Staphylococcus aureus
  MISC_FEATURE (1)..(79): tRNA pseudouridine 5S
MYNGILPVYKERGLTSHDVVFKLRKILKTKKIGHTGTLDPEVAGVLPVCIGNATRVSDYVMDMGKAYEATVSIGRSTTD

SEQ ID NO: 4729 - DNA, 297 bp, Staphylococcus aureus
atggatatcatcaacaataaagtcaaagatcctcgagttggttttattacaattacagatgttgttttaacaaatgatttatcgcaggctaaagtatttttaactgtattaggtaacgataaagaagtagaaaatacatttaaagcacttgataaagcaaaaggcttcattaagtctgaattaggttctagaatgcgattacgtattatgccggaattaatgtatgaatatgatcaatcaatcgaatatggtaataaaattgaacgaatgattcaagatttacacaaacaagataga

SEQ ID NO: 4730 - protein, 99 aa, Staphylococcus aureus
  MISC_FEATURE (1)..(99): ribosome-binding factor A
MDIINNKVKDPRVGFITITDVVLTNDLSQAKVFLTVLGNDKEVENTFKALDKAKGFIKSELGSRMRLRIMPELMYEYDQSIEYGNKIERMIQDLHKQDR

SEQ ID NO: 4731 - DNA, 2139 bp, Staphylococcus aureus
atgaatatcataaggagtgattatatgagtaaacaaagaatttacgaatatgcgaaagaattaaatctaaagagtaaagagattatagatgagttaaaaagcatgaatattgaggtttcaaatcatatgcaagctttggaagatgaccaaattaaagcattagataaaaagttcaaaaaagaacaaaagaacgacaataaacaaagcactcaaaataatcaccaaaaatcaaacaatcaaaaccaaaataaagggcaacaaaaagataacaaaaagaatcaacaacaaaataataaaggcaacaaaggcaataaaaagaataatagaaataataagaaaaataacaagaataataaaccacaaaatcaaccagctgctccaaaagaaataccatcaaaagtgacatatcaagaaggtattacagtaggcgaatttgcggataaattaaatgttgaatcatcagaaattatcaaaaaattattcttacttggtattgttgctaatatcaatcaatcattaaatcaagaaacaatcgaattaattgccgatgattatggcgttgaggttgaagaagaagttgtgattaatgaagaagacttatcaatctatttcgaagacgaaaaagatgatccagaggcaattgagagaccagcagttgtaacaattatgggacatgttgaccatggtaaaacgactttattagattcaattcgtcatacaaaagttacagcaggtgaagcaggcggaatcactcaacatattggtgcatatcaaattgaaaacgatggcaaaaaaatcactttcttagatacaccgggacatgctgcatttacaacgatgcgtgcgcgtggtgcacaagtaacagatattactattttagtagtagcagctgacgatggtgttatgccacaaacaattgaagcaattaaccatgctaaagaagcagaagtaccaattattgttgcagtaaataaaattgataaaccaacttcaaatcctgatcgagttatgcaagaattaactgaatatggtttaattcctgaagattggggcggcgaaacaattttcgttccactttctgcattaagtggtgatggtatcgacgatttattagaaatgataggattagttgcagaagttcaagaacttaaagcaaatcctaaaaaccgtgctgttggtacagttatcgaagctgaattagataaatcacgtggtccttctgcatcattattagtacaaaacggtacattaaatgttggtgatgcgattgtagttggtaatacttacggccgtatccgtgcaatggttaatgacttaggtcaaagaatcaaaacggctggtccatcaacgcctgttgaaattacaggtattaatgatgtgccacaagctggggatcgctttgttgtatttagtgatgaaaaacaagctcgtcgtattggtgaatcaagacacgaagctagcattatacaacaacgtcaagaaagtaaaaatgtttcattagataacctgtttgaacaaatgaaacaaggtgaaatgaaagatttaaacgttattattaaaggtgatgttcaaggttctgttgaagctttagctgcatcattaatgaaaattgatgttgaaggcgtaaatgttcgtatcattcatacagcggttggtgcaattaatgagtcagacgtgacacttgctaatgcctcaaatggtattatcattggtttcaatgttcgtccagacagtggtgcaaaacgtgctgcagaagctgaaaatgttgatatgcgtttacacagagttatttataatgttatcgaagaaattgaatcagcgatgaaaggtttacttgatccagaatttgaagaacaagttatcggacaagctgaagttcgtcaaacattcaaagtttctaaagttggtactattgctggatgttatgttactgaaggtaaaattacgcgaaatgctggtgtacgtattattcgtgatggtattgttcaatatgaaggcgaattagatacacttaaacgtttcaaagatgatgctaaggaagttgcaaaaggttatgaatgtggtattacaattgaaaactacaatgaccttaaagaaggcgatgttatcgaagcatttgaaatggttgaaattaagcgt

SEQ ID NO: 4732 - protein, 713 aa, Staphylococcus aureus
  MISC_FEATURE (1)..(713): translation initiation
MNIIRSDYMSKQRIYEYAKELNLKSKEIIDELKSMNIEVSNHMQALEDDQIKALDKKFKKEQKNDNKQSTQNNHQKSNNQNQNKGQQKDNKKNQQQNNKGNKGNKKNNRNNKKNNKNNKPQNQPAAPKEIPSKVTYQEGITVGEFADKLNVESSEIIKKLFLLGIVANINQSLNQETIELIADDYGVEVEEEVVINEEDLSIYFEDEKDDPEAIERPAVVTIMGHVDHGKTTLLDSIRHTKVTAGEAGGITQHIGAYQIENDGKKITFLDTPGHAAFTTMRARGAQVTDITILVVAADDGVMPQTIEAINHAKEAEVPIIVAVNKIDKPTSNPDRVMQELTEYGLIPEDWGGETIFVPLSALSGDGIDDLLEMIGLVAEVQELKANPKNRAVGTVIEAELDKSRGPSASLLVQNGTLNVGDAIVVGNTYGRIRAMVNDLGQRIKTAGPSTPVEITGINDVPQAGDRFVVFSDEKQARRIGESRHEASIIQQRQESKNVSLDNLFEQMKQGEMKDLNVIIKGDVQGSVEALAASLMKIDVEGVNVRIIHTAVGAINESDVTLANASNGIIIGFNVRPDSGAKRAAEAENVDMRLHRVIYNVIEEIESAMKGLLDPEFEEQVIGQAEVRQTFKVSKVGTIAGCYVTEGKITRNAGVRIIRDGIVQYEGELDTLKRFKDDAKEVAKGYECGITIENYNDLKEGDVIEAFEMVEIKR

SEQ ID NO: 4733 - DNA, 315 bp, Staphylococcus aureus
atgagtatagatcaaatattaaactttttaggattagcaatgagagctggtaaagtaaaaacaggtgaatcagtcattgttaatgagattaaaaaaggaaatttgaagctcgttattgttgcaaatgatgcgtctgataatacagctaaattaattacagataaatgtaagagttacaaagttccattcagaaagtttggaaatcgaaatgaattgggaatagcacttggaaaaggtgagcgtgttaatgtagggattactgacccaggctttgctaaaaagttgctatcaatgatagatgaatatcataaggag

SEQ ID NO: 4734 - protein, 105 aa, Staphylococcus aureus
  MISC_FEATURE (1)..(105): hypothetical protein
MSIDQILNFLGLAMRAGKVKTGESVIVNEIKKGNLKLVIVANDASDNTAKLITDKCKSYKVPFRKFGNRNELGIALGKGERVNVGITDPGFAKKLLSMIDEYHKE

SEQ ID NO: 4735 - DNA, 282 bp, Staphylococcus aureus
atgaaaaagaaaaaaattccgatgcgaaaatgtattctttcaaatgaaatgcatcccaaaaaagatatgattcgtgttgttgttaataaagaaggcgaaatctttgcggatgttactggaaagaaacaaggccgtggcgcatatgtttctaaagatgttgctatggttgaaaaagcacaacaaaaagaaattttagaaaaatattttaaagcatctaaagagcaattggatcctgtttacaaagaaattattagattaatttatagagaagagatcccaaaa

SEQ ID NO: 4736 - protein, 94 aa, Staphylococcus aureus
  MISC_FEATURE (1)..(94): conserved hypothetical
MKKKKIPMRKCILSNEMHPKKDMIRVVVNKEGEIFADVTGKKQGRGAYVSKDVAMVEKAQQKEILEKYFKASKEQLDPVYKEIIRLIYREEIPK

SEQ ID NO: 4737 - DNA, 1383 bp, Staphylococcus aureus
ttgagggaggacatcgatatggcatttgaagggttatcagaacgcttgcaagcgacgatgcaaaaaatgcgtggtaagggtaaacttactgaagctgatataaagataatgatgcgtgaagtaagattagcgttacttgaggctgacgtaaactttaaagtggtaaaagaatttattaaaacagtatcagaacgcgcattaggttccgatgtaatgcaatcattaacaccagggcaacaagttattaaaatagttcaagatgaattaacgcagttgatgggtggagaaaatacgtcgattaatatgtcaaataaaccacctactgttgttatgatggttggtttacaaggtgctggtaaaacaacaactgcaggtaaattagcattattgatgcgtaaaaaatacaacaaaaaacctatgttagttgcagcagatatttatcgtccagcagcgataaatcaattacaaacagtagggaaacaaattgatattcctgtatacagtgaaggagatcaagtaaagccacaacaaattgtaactaatgcattaaaacatgctaaagaagaacatttagactttgtaatcattgatacagcaggtcgattacacatcgatgaagcattgatgaacgaattaaaagaagtaaaagacattgctaaaccaaacgaaattatgttagttgtcgattcaatgacgggtcaagatgctgtcaatgttgcagaatcttttgacgatcaacttgatgtcacaggtgttaccttaactaaattagatggtgatacacgtggtggtgcagctttatctattcgttcggtgacacaaaaaccaattaaatttgttggtatgagtgaaaagttagatggtttagagctattccatcctgaacgtatggcatcacgtattttaggtatgggtgatgtgttaagtttaattgaaaaagcgcaacaagatgtggatcaagaaaaagcaaaagatttagagaaaaagatgcgtgagtcatcgtttactttagatgattttttagaacaacttgatcaggtgaaaaatctaggaccactggatgatattatgaaaatgattccaggtatgaataaaatgaaagggctagataagcttaatatgagtgaaaagcaaattgatcatattaaagcgattatccagtcaatgacgccggctgaaagaaacaatccagacacattgaatgtatcacgtaaaaagcgtattgctaaagggtctggtcgttcattacaagaagtcaatcgtttgatgaaacaatttaacgatatgaagaaaatgatgaaacagttcactggtggcggtaaaggtaaaaaaggtaaacgcaatcaaatgcaaaatatgttaaaaggtatgaatttaccgttt

SEQ ID NO: 4738 - protein, 461 aa, Staphylococcus aureus
  MISC_FEATURE (1)..(461): signal recognition particle
LREDIDMAFEGLSERLQATMQKMRGKGKLTEADIKIMMREVRLALLEADVNFKVVKEFIKTVSERALGSDVMQSLTPGQQVIKIVQDELTQLMGGENTSINMSNKPPTVVMMVGLQGAGKTTTAGKLALLMRKKYNKKPMLVAADIYRPAAINQLQTVGKQIDIPVYSEGDQVKPQQIVTNALKHAKEEHLDFVIIDTAGRLHIDEALMNELKEVKDIAKPNEIMLVVDSMTGQDAVNVAESFDDQLDVTGVTLTKLDGDTRGGAALSIRSVTQKPIKFVGMSEKLDGLELFHPERMASRILGMGDVLSLIEKAQQDVDQEKAKDLEKKMRESSFTLDDFLEQLDQVKNLGPLDDIMKMIPGMNKMKGLDKLNMSEKQIDHIKAIIQSMTPAERNNPDTLNVSRKKRIAKGSGRSLQEVNRLMKQFNDMKKMMKQFTGGGKGKKGKRNQMQNMLKGMNLPF

SEQ ID NO: 4739 - DNA, 1173 bp, Staphylococcus aureus
gtgtcaagtaatgaattattattagctactgagtatttagaaaaagaaaagaagattcctagagcagtattaattgatgctattgaagcagctttaattactgcatacaaaaagaattatgatagtgcaagaaatgtccgtgtggaattaaatatggatcaaggtactttcaaagttatcgctcgtaaagatgttgttgaagaagtatttgacgacagagatgaagtggatttaagtacagcgcttgttaaaaaccctgcatatgaaattggtgatatatacgaagaagatgtaacacctaaagattttggtcgtgtaggtgctcaagcagcgaaacaagcagtaatgcaacgtcttcgtgatgctgaacgtgaaattttatttgaagaatttatagacaaagaagaagacatacttactggaattattgaccgtgttgaccatcgttatgtatatgtgaatttaggtcgtatcgaagctgttttatctgaagcagaaagaagtcctaacgaaaaatatattcctaacgaacgtatcaaagtatatgttaacaaagtggaacaaacgacaaaaggtcctcaaatctatgtttctcgtagccatccaggtttattaaaacgtttatttgaacaagaagttccagaaatttacgatggtactgtaattgttaaatcagtagcacgtgaagctggcgatcgctctaaaattagtgtcttctctgaaaacaatgatatagatgctgttggtgcatgtgttggtgctaaaggcgcacgtgttgaagctgttgttgaagagctaggtggtgaaaaaatcgacatcgttcaatggaatgaagatccaaaagtatttgtaaaaaatgctttaagcccttctcaagttttagaagttattgttgatgaaacaaatcaatctacagtagttgttgttcctgattatcaattgtcattagcgattggtaaaagaggacaaaacgcacgtctagctgctaaattaaccggctggaaaattgatattaaatcagaaacagatgcgcgtgaagcgggtatctatccagtagttgaagctgaaaaagtaactgaagaagatgttgctttagaagatgctgacacaacagaatcaaccgaagaggtaaatgatgtttcagttgaaacaaatgtagagaaagaatctgaa

SEQ ID NO: 4740 - protein, 391 aa, Staphylococcus aureus
  MISC_FEATURE (1)..(391): transcription
VSSNELLLATEYLEKEKKIPRAVLIDAIEAALITAYKKNYDSARNVRVELNMDQGTFKVIARKDVVEEVFDDRDEVDLSTALVKNPAYEIGDIYEEDVTPKDFGRVGAQAAKQAVMQRLRDAEREILFEEFIDKEEDILTGIIDRVDHRYVYVNLGRIEAVLSEAERSPNEKYIPNERIKVYVNKVEQTTKGPQIYVSRSHPGLLKRLFEQEVPEIYDGTVIVKSVAREAGDRSKISVFSENNDIDAVGACVGAKGARVEAVVEELGGEKIDIVQWNEDPKVFVKNALSPSQVLEVIVDETNQSTVVVVPDYQLSLAIGKRGQNARLAAKLTGWKIDIKSETDAREAGIYPVVEAEKVTEEDVALEDADTTESTEEVNDVSVETNVEKESE

SEQ ID NO: 4741 - DNA, 411 bp, Staphylococcus aureus
ttgaattttgaacttgtagacgttgaatatgtcaaagagggtagagatcattttcttagaatctctattgataaagaaggtggcgtagatttaaatgattgtacgctagcttctgaaaaaataagtgaagctatggatgcaaatgatcctattcctgaaatgtattatttagacgtagcgtcacctggtgcagaacgtccaattaaaaaagaacaagatttccaaaatgcaataactaaacctgtatttgtttctttatatgtaccaattgaaggtgaaaaggaatggttaggcattttacaagaagtcaataatgaaacaattgtagtacaagttaaaatcaaagcaagaacgaaagatatagagataccgagagacaaaatagcaaaagcacgtcacgcagttatgatt

SEQ ID NO: 4742 - protein, 137 aa, Staphylococcus aureus
  MISC_FEATURE (1)..(137): conserved hypothetical
LNFELVDVEYVKEGRDHFLRISIDKEGGVDLNDCTLASEKISEAMDANDPIPEMYYLDVASPGAERPIKKEQDFQNAITKPVFVSLYVPIEGEKEWLGILQEVNNETIVVQVKIKARTKDIEIPRDKIAKARHAVMI

SEQ ID NO: 4743 - DNA, 4326 bp, Staphylococcus aureus
gtggtaattgtcttggcaatgacagagcaacaaaaatttaaagtgcttgctgatcaaattaaaatttcaaatcaattagatgctgaaattttaaattcaggtgaactgacacgtatagatgtttctaacaaaaacagaacatgggaatttcatattacattaccacaattcttagctcatgaagattatttattatttataaatgcaatagagcaagagtttaaagatatcgccaacgttacatgtcgttttacggtaacaaatggcacgaatcaagatgaacatgcaattaaatactttgggcactgtattgaccaaacagctttatctccaaaagttaaaggtcaattgaaacagaaaaagcttattatgtctggaaaagtattaaaagtaatggtatcaaatgacattgaacgtaatcattttgataaggcatgtaatggaagtcttatcaaagcgtttagaaattgtggttttgatatcgataaaatcatattcgaaacaaatgataatgatcaagaacaaaacttagcttctttagaagcacatattcaagaagaagacgaacaaagtgcacgattggcaacagagaaacttgaaaaaatgaaagctgaaaaagcgaaacaacaagataacaacgaaagtgctgtcgataagtgtcaaattggtaagccgattcaaattgaaaatattaaaccaattgaatctattattgaggaagagtttaaagttgcaatagagggtgtcatttttgatataaacttaaaagaacttaaaagtggtcgccatatcgtagaaattaaagtgactgactatacggactctttagttttaaaaatgtttactcgtaaaaacaaagatgatttagaacattttaaagcgctaagtgttggtaaatgggttagggctcaaggtcgtattgaagaagatacatttattagagatttagttatgatgatgtctgatattgaagagattaaaaaagcgacaaaaaaagataaggctgaagaaaagcgtgtagaattccacttgcatactgcaatgagccaaatggatggtatacccaatattggtgcgtatgttaaacaggcagcagactggggacatccagccattgcggttacagaccataatgttgtgcaagcatttccagatgctcacgcagcagcggaaaaacatggcattaaaatgatatacggtatggaaggtatgttagttgatgatggtgttccgattgcatacaaaccacaagatgtcgtattaaaagatgctacttatgttgtgttcgacgttgagacaactggtttatcaaatcagtatgataaaatcatcgagcttgcagctgtgaaagttcataacggtgaaatcatcgataagtttgaaaggtttagtaatccgcatgaacgattatcggaaacgattatcaatttgacgcatattactgatgatatgttagtagatgcccctgagattgaagaagtacttacagagtttaaagaatgggttggcgatgcgatattcgtagcgcataatgcttcgtttgatatgggcttcatcgatacgggatatgaacgtcttgggtttggaccatcaacgaatggtgttatcgatactttagaattatctcgtacgattaatactgaatatggtaaacatggtttgaatttcttggctaaaaaatatggcgtagaattaacgcaacatcaccgtgccatttatgatacagaagcaacagcttacattttcataaaaatggttcaacaaatgaaagaattaggcgtattaaatcataacgaaatcaacaaaaaactcagtaatgaagatgcatataaacgtgcaagacctagtcatgtcacattaattgtacaaaaccaacaaggtcttaaaaatctatttaaaattgtaagtgcatcattggtgaagtatttctaccgtacacctcgaattccacgttcattgttagatgaatatcgtgagggattattggtaggtacagcgtgtgatgaaggtgaattatttacggcagttatgcagaaggaccagagtcaagttgaaaaaattgccaaatattatgattttattgaaattcaaccaccggcactttatcaagatttaattgatagagagcttattagagatactgaaacattacatgaaatttatcaacgtttaatacatgcaggtgacacagcgggtatacctgttattgcgacaggaaatgcacactatttgtttgaacatgatggtatcgcacgtaaaattttaatagcatcacaacccggcaatccacttaatcgctcaactttaccggaagcacattttagaactacagatgaaatgttaaacgagtttcattttttaggtgaagaaaaagcgcatgaaattgttgtgaaaaatacaaacgaattagcagatcgaattgaacgtgttgttcctattaaagatgaattatacacaccgcgtatggaaggtgctaacgaagaaattagagaactaagttatgcaaatgcgcgtaaactgtatggtgaagacctgcctcaaatcgtaattgatcgattagaaaaagaattaaaaagtattatcggtaatggatttgcggtaatttacttaatttcgcaacgtttagttaaaaaatcattagatgatggatacttagttggttcccgtggttcagtaggttctagttttgtagcgacaatgactgagattactgaagtaaacccgttaccgccacactatatttgtccgaactgtaaaacgagtgaatttttcaatgatggttcagtaggatcaggatttgatttacctgataagacgtgtgaaacttgtggagcgccacttattaaagaaggacaagatattccgtttgaaacatttttaggatttaagggagataaagttcctgatatcgacttaaactttagtggtgaatatcaaccgaatgcccataactacacaaaagtattatttggtgaggataaagtattccgtgcaggtacaattggtactgttgctgaaaagactgcttttggttatgttaaaggttatttgaatgatcaaggtatccacaaaagaggtgctgaaatagatcgactcgttaaaggatgtacaggtgttaaacgtacaactggacagcatccagggggtattattgtagtacctgattacatggatatttatgattttacgccgatacaatatcctgccgatgatcaaaattcagcatggatgacgacacattttgatttccattctattcatgataatgtattaaaacttgatatacttggacacgatgatccaacaatgattcgtatgcttcaagatttatcaggaattgatccaaaaacaatacctgtagatgataaagaagttatgcagatatttagtacacctgaaagtttgggtgttactgaagatgaaattttatgtaaaacaggtacatttggggtaccagaattcggtacaggattcgtgcgtcaaatgttagaagatacaaagccaacaacattttctgaattagttcaaatctcaggattatctcatggtacagatgtgtggttaggcaatgctcaagaattaattaaaaccggtatatgtgatttatcaagtgtaattggttgtcgtgatgatatcatggtttatttaatgtatgctggtttagaaccatcaatggcttttaaaataatggagtcagtacgtaaaggtaaaggtttaactgaagaaatgattgaaacgatgaaagaaaatgaagtgccagattggtatttagattcatgtcttaaaattaagtacatgttccctaaagcccatgcagcagcatacgttttaatggcagtacgtatcgcatatttcaaagtacatcatccactttattactatgcatcttactttacaattcgtgcgtcagactttgatttaatcacgatgattaaagataaaacaagcattcgaaatactgtaaaagacatgtattctcgctatatggatctaggtaaaaaagaaaaagacgtattaacagtcttggaaattatgaatgaaatggcgcatcgaggttatcgaatgcaaccgattagtttagaaaagagtcaggcgttcgaatttatcattgaaggcgatacacttattccgccgttcatatcagtgcctgggcttggcgaaaacgttgcgaaacgaattgttgaagctcgtgacgatggcccatttttatcaaaagaagatttaaacaaaaaagctggattatctcagaaaattattgagtatttagatgagttaggctcattaccgaatttaccagataaagctcaactttcgatatttgatatg

SEQ ID NO: 4744 - protein, 1442 aa, Staphylococcus aureus
  MISC_FEATURE (1)..(1442): DNA polymerase III alpha
VVIVLAMTEQQKFKVLADQIKISNQLDAEILNSGELTRIDVSNKNRTWEFHITLPQFLAHEDYLLFINAIEQEFKDIANVTCRFTVTNGTNQDEHAIKYFGHCIDQTALSPKVKGQLKQKKLIMSGKVLKVMVSNDIERNHFDKACNGSLIKAFRNCGFDIDKIIFETNDNDQEQNLASLEAHIQEEDEQSARLATEKLEKMKAEKAKQQDNNESAVDKCQIGKPIQIENIKPIESIIEEEFKVAIEGVIFDINLKELKSGRHIVEIKVTDYTDSLVLKMFTRKNKDDLEHFKALSVGKWVRAQGRIEEDTFIRDLVMMMSDIEEIKKATKKDKAEEKRVEFHLHTAMSQMDGIPNIGAYVKQAADWGHPAIAVTDHNVVQAFPDAHAAAEKHGIKMIYGMEGMLVDDGVPIAYKPQDVVLKDATYVVFDVETTGLSNQYDKIIELAAVKVHNGEIIDKFERFSNPHERLSETIINLTHITDDMLVDAPEIEEVLTEFKEWVGDAIFVAHNASFDMGFIDTGYERLGFGPSTNGVIDTLELSRTINTEYGKHGLNFLAKKYGVELTQHHRAIYDTEATAYIFIKMVQQMKELGVLNHNEINKKLSNEDAYKRARPSHVTLIVQNQQGLKNLFKIVSASLVKYFYRTPRIPRSLLDEYREGLLVGTACDEGELFTAVMQKDQSQVEKIAKYYDFIEIQPPALYQDLIDRELIRDTETLHEIYQRLIHAGDTAGIPVIATGNAHYLFEHDGIARKILIASQPGNPLNRSTLPEAHFRTTDEMLNEFHFLGEEKAHEIVVKNTNELADRIERVVPIKDELYTPRMEGANEEIRELSYANARKLYGEDLPQIVIDRLEKELKSIIGNGFAVIYLISQRLVKKSLDDGYLVGSRGSVGSSFVATMTEITEVNPLPPHYICPNCKTSEFFNDGSVGSGFDLPDKTCETCGAPLIKEGQDIPFETFLGFKGDKVPDIDLNFSGEYQPNAHNYTKVLFGEDKVFRAGTIGTVAEKTAFGYVKGYLNDQGIHKRGAEIDRLVKGCTGVKRTTGQHPGGIIVVPDYMDIYDFTPIQYPADDQNSAWMTTHFDFHSIHDNVLKLDILGHDDPTMIRMLQDLSGIDPKTIPVDDKEVMQIFSTPESLGVTEDEILCKTGTFGVPEFGTGFVRQMLEDTKPTTFSELVQISGLSHGTDVWLGNAQELIKTGICDLSSVIGCRDDIMVYLMYAGLEPSMAFKIMESVRKGKGLTEEMIETMKENEVPDWYLDSCLKIKYMFPKAHAAAYVLMAVRIAYFKVHHPLYYYASYFTIRASDFDLITMIKDKTSIRNTVKDMYSRYMDLGKKEKDVLTVLEIMNEMAHRGYRMQPISLEKSQAFEFIIEGDTLIPPFISVPGLGENVAKRIVEARDDGPFLSKEDLNKKAGLSQKIIEYLDELGSLPNLPDKAQLSIFDM

SEQ ID NO: 4745 - DNA, 1701 bp, Staphylococcus aureus
atgaagcaatccaaagtttttataccaacgatgcgtgacgtgccatcagaagcagaagcacaaagtcatcgtttattattgaaatcgggtttgataaaacaaagtacaagtgggatttatagttatttaccgctagcaacacgtgtgttaaataatattactgcaattgtgcgacaagaaatggaacgtatcgattctgttgaaattttaatgccagcgttacaacaagctgaattatgggaagaatcaggacgttggggtgcatatggcccagaattaatgcgtttacaagatagacatggaagacaatttgcattaggtccaacacatgaagaattagttacatcaatagtaagaaatgaattgaaatcatacaaacaattaccgatgacattattccaaattcaatctaaattccgtgatgaaaagagaccacgttttggtttacttcgtgggcgtgaatttattatgaaagatgcatattcattccatgctgacgaggcatcattagatcaaacgtatcaagatatgtatcaagcgtatagccgtatttttgagagagttggcattaacgcaagaccagtagttgcagattcaggtgctataggcggtagccatacacatgaatttatggcattaagtgctatcggtgaggatacaatcgtttacagtaaagaaagtgattatgctgctaacatcgaaaaagcagaagtcgtttacgaaccaaatcataagcatactactgtgcaacctttagaaaaaattgaaacaccaaatgttaagactgcgcaagaattggcagacttcttaggtagaccagtagatgaaatcgttaaaacgatgattttcaaagttgatggcgaatatattatggttttagtgcgtggccatcatgaaattaatgacattaaattaaaatcttatttcggcacagataatattgaattagcaacacaagacgaaattgttaatttagttggtgcaaatcctggttcactaggtcctgtaattgataaagaaatcaaaatttatgcagataattttgtgcaagatttaaataatttagttgtcggtgctaacgaagatggttatcacttaattaatgtaaatgtaggtagagacttcaacgttgatgaatatggcgatttccgttttattttagaaggcgaaaagttaagtgatggttcaggcgttgcacattttgctgaaggtattgaagttggtcaagtattcaaattgggtactaagtattcagaatcaatgaatgctacattcttagataaccaaggaaaagctcaatctttaattatgggttgttacggaattggaatttctagaacgctaagtgcgattgttgaacaaaatcacgatgataatggaattgtttggcctaaatcagttactccgtttgatttacatttaatttctattaatcctaagaaagatgatcaacgagaactagcagatgcactatatgctgaatttaatactaaatttgatgtgttgtacgatgatcgtcaggaacgtgcaggtgttaaatttaatgatgccgatttaattggtttaccactgcgaattgttgttggtaaacgtgcatcggaaggtattgtagaagttaaagaacgtttaacaggtgatagcgaagaagttcacattgatgacttaatgactgtcattacaaataaatatgataacttaaaa

SEQ ID NO: 4746 - protein, 567 aa, Staphylococcus aureus
  MISC_FEATURE (1)..(567): proline-tRNA ligase
MKQSKVFIPTMRDVPSEAEAQSHRLLLKSGLIKQSTSGIYSYLPLATRVLNNITAIVRQEMERIDSVEILMPALQQAELWEESGRWGAYGPELMRLQDRHGRQFALGPTHEELVTSIVRNELKSYKQLPMTLFQIQSKFRDEKRPRFGLLRGREFIMKDAYSFHADEASLDQTYQDMYQAYSRIFERVGINARPVVADSGAIGGSHTHEFMALSAIGEDTIVYSKESDYAANIEKAEVVYEPNHKHTTVQPLEKIETPNVKTAQELADFLGRPVDEIVKTMIFKVDGEYIMVLVRGHHEINDIKLKSYFGTDNIELATQDEIVNLVGANPGSLGPVIDKEIKIYADNFVQDLNNLVVGANEDGYHLINVNVGRDFNVDEYGDFRFILEGEKLSDGSGVAHFAEGIEVGQVFKLGTKYSESMNATFLDNQGKAQSLIMGCYGIGISRTLSAIVEQNHDDNGIVWPKSVTPFDLHLISINPKKDDQRELADALYAEFNTKFDVLYDDRQERAGVKFNDADLIGLPLRIVVGKRASEGIVEVKERLTGDSEEVHIDDLMTVITNKYDNLK

SEQ ID NO: 4747 - DNA, 1284 bp, Staphylococcus aureus
gtgagctatttagttacaataattgcatttattattgtttttggtgtactagtaactgttcatgaatatggccatatgttttttgcgaaaagagcaggcattatgtgtccagaatttgcgatcggtatggggccaaaaatttttagttttagaaaaaatgaaacactttacactattaggttattgcctgttggtggatatgttcgtatggcaggagatggcttagaagagccaccagtcgagcccggtatgaacgttaaaattaaacttaatgaagaaaatgaaataacacatatcatattagatgatcatcataagtttcaacaaattgaagcgatcgaagttaaaaaatgtgattttaaggatgacttattcatagaaggtatcactgcttatgataatgaaagacatcattttaaaattgctagaaagtctttctttgttgaaaatggtagcttagttcaaattgctccgagagacagacaatttgcacataaaaagccatggccgaaatttttaacattatttgcgggaccgttatttaactttatattagctttagtcctatttattggtcttgcatattatcaaggcacgcctacgtctactgtagaacaagtcgcagataagtatccagctcaacaagcaggattacaaaaaggtgataagatcgtccaaattggcaaatataaaatatctgaatttgatgatgttgataaggcgttagataaagttaaagataataagacgactgttaaatttgaacgtgatggtaaaacaaagtcagttgaattaacacctaaaaagactgaaaaaaaactgactaaagtaagttcagagacgaagtatgttctcggattccaaccagcgagtgaacatacactttttaaaccaattgtattcggatttaaaagctttttaatcggtagtacttatatttttacagctgtagtaggtatgttggctagtatatttacgggcggattctcatttgatatgttaaatggtccggttggtatttatcataacgtcgactcagttgttaaagcgggtatcattagcttaattggttacactgcgttattaagtgtaaacttaggtattatgaatttaattcctattcctgcactagacggtggtcgtattttatttgttatatatgaagcgattttcagaaaaccagttaataaaaaagcggaaacaacgattattgctattggtgccattttcatggtcgttataatgatattagtaacgtggaatgatattcgacgatatttctta

SEQ ID NO: 4748 - protein, 428 aa, Staphylococcus aureus
  MISC_FEATURE (1)..(428): conserved hypothetical
VSYLVTIIAFIIVFGVLVTVHEYGHMFFAKRAGIMCPEFAIGMGPKIFSFRKNETLYTIRLLPVGGYVRMAGDGLEEPPVEPGMNVKIKLNEENEITHIILDDHHKFQQIEAIEVKKCDFKDDLFIEGITAYDNERHHFKIARKSFFVENGSLVQIAPRDRQFAHKKPWPKFLTLFAGPLFNFILALVLFIGLAYYQGTPTSTVEQVADKYPAQQAGLQKGDKIVQIGKYKISEFDDVDKALDKVKDNKTTVKFERDGKTKSVELTPKKTEKKLTKVSSETKYVLGFQPASEHTLFKPIVFGFKSFLIGSTYIFTAVVGMLASIFTGGFSFDMLNGPVGIYHNVDSVVKAGIISLIGYTALLSVNLGIMNLIPIPALDGGRILFVIYEAIFRKPVNKKAETTIIAIGAIFMVVIMILVTWNDIRRYFL

SEQ ID NO: 4749 - DNA, 780 bp, Staphylococcus aureus
atgaaagttagaacgctgacagctattattgccttaatcgtattcttgcctatcttgttaaaaggcggccttgtgttaatgatatttgctaatatattagcattgattgcattaaaagaattgttgaatatgaatatgattaaatttgtttcagttcctggtttaattagtgcagttggtcttatcatcattatgttgccacaacatgcagggccatgggtacaagtaattcaattaaaaagtttaattgcaatgagctttattgtattaagttatactgtcttatctaaaaacagatttagttttatggatgctgcattttgcttaatgtctgtggcttatgtaggcattggttttatgttcttttatgaaacgagatcagaaggattacattacatattatatgcctttttaattgtttggcttacagatacaggggcttacttgtttggtaaaatgatgggtaaacataagctttggccagtaataagtccgaataaaacaatcgaaggattcataggtggcttgttctgtagtttgatagtaccacttgcaatgttatattttgtagatttcaatatgaatgtatggatattacttggagtgacattgattttaagtttatttggtcaattaggtgatttagtggaatcaggatttaagcgtcatttcggcgttaaagactcaggtcgaatactacctggacacggtggtattttagaccgatttgacagctttatgtttgtgttaccattattaaatattttattaatacaatct

SEQ ID NO: 4750 - protein, 260 aa, Staphylococcus aureus
  MISC_FEATURE (1)..(260): phosphatidate
MKVRTLTAIIALIVFLPILLKGGLVLMIFANILALIALKELLNMNMIKFVSVPGLISAVGLIIIMLPQHAGPWVQVIQLKSLIAMSFIVLSYTVLSKNRFSFMDAAFCLMSVAYVGIGFMFFYETRSEGLHYILYAFLIVWLTDTGAYLFGKMMGKHKLWPVISPNKTIEGFIGGLFCSLIVPLAMLYFVDFNMNVWILLGVTLILSLFGQLGDLVESGFKRHFGVKDSGRILPGHGGILDRFDSFMFVLPLLNILLIQS

SEQ ID NO: 4751 - DNA, 822 bp, Staphylococcus aureus
ttgtttagtaacttatactatatgacagagatgatcaggctcggaggaaagaccatgtttaaaaagctaataaataaaaagaacactataaataattataatgaagaattagactcgtctaatatacctgaacatatcgctattattatggatggtaatgggcgatgggctaagaagcgaaaaatgcctagaattaaaggtcattacgaaggtatgcaaacaataaaaaaaattactagggtagctagtgatattggtgttaagtacttaactttatacgccttttccactgaaaattggtcaagacctgaaagtgaagtaaattatattatgaatttgcctgtcaatttcttaaagacattcttaccggaactaattgaaaaaaatgtcaaagttgaaacaattggatttactgataagttgccaaaatcaacgatagaagcaattaataatgctaaagaaaagacagctaataataccggcttaaaattaatatttgcaattaattatggtggcagagcagaacttgttcatagtattaaaaatatgtttgacgagcttcatcaacaaggtttaaatagtgatatcatagatgaaacatatataaacaatcatttaatgacaaaagactatcctgatccagagttgttaattcgtacttcaggagaacaaagaataagtaatttcttgatttggcaagtttcgtatagtgaatttatctttaatcaaaaattatggcctgactttgacgaagatgaattaattaaatgtataaaaatttatcagtcacgtcaaagacgctttggcggattgagtgaggag

SEQ ID NO: 4752 - protein, 274 aa, Staphylococcus aureus
  MISC_FEATURE (1)..(274): undecaprenyl
LFSNLYYMTEMIRLGGKTMFKKLINKKNTINNYNEELDSSNIPEHIAIIMDGNGRWAKKRKMPRIKGHYEGMQTIKKITRVASDIGVKYLTLYAFSTENWSRPESEVNYIMNLPVNFLKTFLPELIEKNVKVETIGFTDKLPKSTIEAINNAKEKTANNTGLKLIFAINYGGRAELVHSIKNMFDELHQQGLNSDIIDETYINNHLMTKDYPDPELLIRTSGEQRISNFLIWQVSYSEFIFNQKLWPDFDEDELIKCIKIYQSRQRRFGGLSEE

SEQ ID NO: 4753 - DNA, 552 bp, Staphylococcus aureus
atgagtgacattattaatgaaactaaatcaagaatgcaaaaatcaatcgaaagcttatcacgtgaattagctaacatcagtgcaggaagagctaattcaaatttattaaacggcgtaacagttgattactatggtgcaccaacacctgtacaacaattagcaagcatcaatgttccagaagcacgtttacttgttatttctccatacgacaaaacttctgtagctgacatcgaaaaagcgataatagcagctaacttaggtgttaacccaacaagtgatggtgaagtgatacgtattgctgtacctgccttaacagaagaacgtagaaaagagcgcgttaaagatgttaagaaaattggtgaagaagctaaagtatctgttcgaaatattcgtcgtgatatgaatgatcagttgaaaaaagatgaaaaaaatggcgacattactgaagatgagttgagaagtggcactgaagatgttcagaaagcaacagacaattcaataaaagaaattgatcaaatgattgctgataaagaaaaagatattatgtcagta

SEQ ID NO: 4754 - protein, 184 aa, Staphylococcus aureus
  MISC_FEATURE (1)..(184): ribosome recycling factor
MSDIINETKSRMQKSIESLSRELANISAGRANSNLLNGVTVDYYGAPTPVQQLASINVPEARLLVISPYDKTSVADIEKAIIAANLGVNPTSDGEVIRIAVPALTEERRKERVKDVKKIGEEAKVSVRNIRRDMNDQLKKDEKNGDITEDELRSGTEDVQKATDNSIKEIDQMIADKEKDIMSV

SEQ ID NO: 4755 - DNA, 774 bp, Staphylococcus aureus
gtgtcttctttacttgtatatgttacatatattcacgatagagaggataagaaaatggctcaaatttctaaatataaacgtgtagttttgaaactaagtggtgaagcgttagctggagaaaaaggatttggcataaatccagtaattattaaaagtgttgctgagcaagtggctgaagttgctaaaatggactgtgaaatcgcagtaatcgttggtggcggaaacatttggagaggtaaaacaggtagtgacttaggtatggaccgtggaactgctgattacatgggtatgcttgcaactgtaatgaatgccttagcattacaagatagtttagaacaattggattgtgatacacgagtattaacatctattgaaatgaagcaagtggctgaaccttatattcgtcgtcgtgcaattagacacttagaaaagaaacgcgtagttatttttgctgcaggtattggaaacccatacttctctacagatactacagcggcattacgtgctgcagaagttgaagcagatgttattttaatgggcaaaaataatgtagatggtgtatattctgcagatcctaaagtaaacaaagatgcggtaaaatatgaacatttaacgcatattcaaatgcttcaagaaggtttacaagtaatggattcaacagcatcctcattctgtatggataataacattccgttaactgttttctctattatggaagaaggaaatattaaacgtgctgttatgggtgaaaagataggtacgttaattacaaaa

SEQ ID NO: 4756 - protein, 258 aa, Staphylococcus aureus
  MISC_FEATURE (1)..(258): uridylate kinase
VSSLLVYVTYIHDREDKKMAQISKYKRVVLKLSGEALAGEKGFGINPVIIKSVAEQVAEVAKMDCEIAVIVGGGNIWRGKTGSDLGMDRGTADYMGMLATVMNALALQDSLEQLDCDTRVLTSIEMKQVAEPYIRRRAIRHLEKKRVVIFAAGIGNPYFSTDTTAALRAAEVEADVILMGKNNVDGVYSADPKVNKDAVKYEHLTHIQMLQEGLQVMDSTASSFCMDNNIPLTVFSIMEEGNIKRAVMGEKIGTLITK

SEQ ID NO: 4757 - DNA, 879 bp, Staphylococcus aureus
atggcaactatttcagcaaaacttgttaaagaattacgtgaaaaaactggcgcgggtatgatggattgtaaaaaagcgctaactgaaactgatggtgacatcgataaagcgattgactacctacgtgaaaaaggtattgctaaagcagctaaaaaagcagaccgtattgcggctgaaggtttagtacatgtagaaactaaaggtaacgacgcagttatcgttgaaatcaactctgaaacagactttgttgctcgtaacgaaggtttccaagagttagttaaagaaatcgctaatcaagtattagatacaaaagctgaaactgttgaagctttaatggaaacaactttaccaaatggtaaatcagttgatgaaagaattaaagaagcaatttcaacaatcggtgaaaaattaagtgttcgtcgttttgctatcagaactaaaactgataacgatgctttcggcgcttacttacacatgggtggacgcattggtgtattaacagttgttgaaggttcaactgacgaagaagcagcaagagacgttgctatgcatatcgctgcaatcaaccctaaatatgtttcttctgaacaagttagcgaagaagaaatcaaccacgaaagagaagttttaaaacaacaagcattaaatgaaggtaaaccagaaaacatcgttgaaaaaatggtggaaggacgtttacgtaaatacttacaagaaatttgtgctgtagatcaagacttcgttaaaaaccctgatgtaacagttgaagctttcttaaaaacaaaaggtggaaaacttgttgacttcgtacgctatgaagtaggcgaaggtatggaaaaacgcgaagaaaactttgcggatgaagttaaaggacaaatgaaa

SEQ ID NO: 4758 - protein, 293 aa, Staphylococcus aureus
  MISC_FEATURE (1)..(293): elongation factor TS
MATISAKLVKELREKTGAGMMDCKKALTETDGDIDKAIDYLREKGIAKAAKKADRIAAEGLVHVETKGNDAVIVEINSETDFVARNEGFQELVKEIANQVLDTKAETVEALMETTLPNGKSVDERIKEAISTIGEKLSVRRFAIRTKTDNDAFGAYLHMGGRIGVLTVVEGSTDEEAARDVAMHIAAINPKYVSSEQVSEEEINHEREVLKQQALNEGKPENIVEKMVEGRLRKYLQEICAVDQDFVKNPDVTVEAFLKTKGGKLVDFVRYEVGEGMEKREENFADEVKGQMK

SEQ ID NO: 4759 - DNA, 330 bp, Staphylococcus aureus
atgggtcaaaatgatttagttaaaacgttacgaatgaattatttgtttgatttttatcaatccttattgacgaataaacaacgtaattatttggaattattttatcttgaagattattctttaagtgaaatcgcagatacttttaatgtgagtagacaagcagtttatgataatataagaagaactggcgatttagttgaagattatgaaaagaaattggaattataccagaaatttgagcaacgccgagaaatatatgatgaaatgaaacaacatttaagtaatccagaacaaatacaacgttatattcaacaattagaagacttagaa

SEQ ID NO: 4760 - protein, 110 aa, Staphylococcus aureus
  MISC_FEATURE (1)..(110): conserved hypothetical
MGQNDLVKTLRMNYLFDFYQSLLTNKQRNYLELFYLEDYSLSEIADTFNVSRQAVYDNIRRTGDLVEDYEKKLELYQKFEQRREIYDEMKQHLSNPEQIQRYIQQLEDLE

SEQ ID NO: 4761 - DNA, 111 bp, Staphylococcus aureus
atgggtgataagatattaatgcttatcaccttttttaaaaagaaaatcgaggcaaattacaaatattcaattagagtattggcaatcttgcctataataatgctaaaatca

SEQ ID NO: 4762 - protein, 37 aa, Staphylococcus aureus
MGDKILMLITFFKKKIEANYKYSIRVLAILPIIMLKS

SEQ ID NO: 4763 - DNA, 687 bp, Staphylococcus aureus
atgaaaaaatatatcttcactgagagaaatggtatttatatcatcgacttacaaaaaacagtgaaaaaagtagacgaggcatacaacttcttgaaacaagtttcagaagatggtggacaagtcttattcgtaggaactaaaaaacaagcacaagaatcagttaaatctgaagcagaacgtgctggtcaattctacattaaccaaagatggttaggtggattattaactaactataaaacgatctcaaaacgaatcaaacgtatttctgaaattgaaaaaatggaagaagatggtttattcgaagtattacctaaaaaagaagtagtagaacttaaaaaagaatacgaccgtttaatcaaattcttaggcggaattcgtgatatgaaatcaatgcctcaagcattattcgtagttgacccacgtaaagagcgtaatgcaattgctgaagctcgtaaattaaatattcctatcgtaggtatcgttgacactaactgtgatcctgacgaaattgactacgttatcccagcaaacgacgatgctatccgtgcggttaaattattaactgctaaaatggcagatgcaatcttagaaggtcaacaaggcgtttctaatgaagaagtagctgcagaacaaaacatcgatttagatgaaaaagaaaaatcagaagaaacagaagcaactgaagaa

SEQ ID NO: 4764 - protein, 229 aa, Staphylococcus aureus
  MISC_FEATURE (1)..(229): 30S ribosomal protein S2
MKKYIFTERNGIYIIDLQKTVKKVDEAYNFLKQVSEDGGQVLFVGTKKQAQESVKSEAERAGQFYINQRWLGGLLTNYKTISKRIKRISEIEKMEEDGLFEVLPKKEVVELKKEYDRLIKFLGGIRDMKSMPQALFVVDPRKERNAIAEARKLNIPIVGIVDTNCDPDEIDYVIPANDDAIRAVKLLTAKMADAILEGQQGVSNEEVAAEQNIDLDEKEKSEETEATEE

SEQ ID NO: 4765 - DNA, 99 bp, Staphylococcus aureus
atggcagtaatttcaatgaaacaattactagaagcgggtgttcacttcggtcaccaaacacgtcgtgtggaacccaaaaatgaaaaaatatatcttcac

SEQ ID NO: 4766 - protein, 33 aa, Staphylococcus aureus
MAVISMKQLLEAGVHFGHQTRRVEPKNEKIYLH

SEQ ID NO: 4767 - DNA, 90 bp, Staphylococcus aureus
ttggcggtagtcaatgaaatgactttgatgattatgttgaagtcatttctttatttttgtctaattttcaatcaaattgatatttcacat

SEQ ID NO: 4768 - protein, 30 aa, Staphylococcus aureus
LAVVNEMTLMIMLKSFLYFCLIFNQIDISH

SEQ ID NO: 4769 - DNA, 183 bp, Staphylococcus aureus
atgaaagtacctttcattcctaaagaacgtgattcaattacaccagcactttctaatttacgtagtgcatttacaattacagatctagtaataccaactctatctgcaacttttgatgcgattaataggccttccgtaccgccaagttcttcaaagatatgttcaatcgcttctttttcagaa

SEQ ID NO: 4770 - protein, 61 aa, Staphylococcus aureus
MKVPFIPKERDSITPALSNLRSAFTITDLVIPTLSATFDAINRPSVPPSSSKICSIASFSE

SEQ ID NO: 4771 - DNA, 771 bp, Staphylococcus aureus
atgagcttattatctaaaacgagagagttaaacacgttacttcaaaaacacaaaggtattgcggttgattttaaagatgtagcacaaacgattagtagcgtaactgtaacaaatgtatttattgtatcgcgtcgaggtaaaattttaggatcgagtctaaatgaattattaaaaagtcaaagaattattcaaatgttggaagaaagacatattccaagtgaatatacagaacgattaatggaagttaaacaaacagaatcaaatattgatatcgacaatgtattaacagtattcccacctgaaaacagagaattattcatagatagtcgtacaactatcttcccaattttaggtggaggggaaagattaggtacattagtacttggtcgagtacatgatgattttaatgaaaatgatttggtactaggtgaatatgctgctacagttattggtatggaaatcttacgtgagaagcatagtgaagtagaaaaagaagcgcgcgataaagctgctattacaatggcaattaattcattatcttattctgaaaaagaagcgattgaacatatctttgaagaacttggcggtacggaaggcctattaatcgcatcaaaagttgcagatagagttggtattactagatctgtaattgtaaatgcactacgtaaattagaaagtgctggtgtaattgaatcacgttctttaggaatgaaaggtactttcattaaagttaaaaaagaaaaattcttagatgaattagaaaaaagtaaa

SEQ ID NO: 4772 - protein, 257 aa, Staphylococcus aureus
  MISC_FEATURE (1)..(257): transcription pleiotropic
MSLLSKTRELNTLLQKHKGIAVDFKDVAQTISSVTVTNVFIVSRRGKILGSSLNELLKSQRIIQMLEERHIPSEYTERLMEVKQTESNIDIDNVLTVFPPENRELFIDSRTTIFPILGGGERLGTLVLGRVHDDFNENDLVLGEYAATVIGMEILREKHSEVEKEARDKAAITMAINSLSYSEKEAIEHIFEELGGTEGLLIASKVADRVGITRSVIVNALRKLESAGVIESRSLGMKGTFIKVKKEKFLDELEKSK

SEQ ID NO: 4773 - DNA, 1410 bp, Staphylococcus aureus
atgaaattaatggatacagctggaataagattaactccaaaagaaatcgtatctaaattaaatgaatacatcgttggacaaaatgatgctaaacgtaaagtggcaattgccctacgtaatcgatacagaagaagtttattagatgaggaatcaaagcaagaaatttcacctaaaaatattttgatgattggaccaaccggcgttggtaaaactgaaattgcaagaagaatggccaaagttgtcggcgcgccatttataaaagtagaagctactaaatttactgaggtaggttatgtaggacgagatgttgaaagtatggttagagatcttgttgatgtttcagtaagattagtcaaggcgcagaaaaaatcattggtacaagatgaagcaacagctaaggccaatgaaaaacttgttaagttattagttccaagtatgaaaaagaaagcgtctcaaacgaataatcctttagagtcacttttcggaggtgcaattccaaatttcggacaaaataacgaagatgaagaagaaccacctactgaggaaattaaaacaaaacgttctgaaattaagagacagctagaagaaggcaaacttgaaaaagaaaaggtaagaattaaagtcgaacaagatcctggtgctttaggtatgctaggtacaaatcaaaatcagcaaatgcaagagatgatgaatcaattaatgcctaaaaagaaagttgagcgagaagttgctgttgagacggcaaggaaaatcttagctgatagttatgcggatgaactaattgatcaagaaagcgctaaccaagaagcgcttgaattagcagaacaaatgggtatcatctttatagatgaaatcgacaaagttgcgacgaataatcataatagtggtcaagatgtctcaagacaaggtgttcaaagagatattttacctatacttgaaggtagcgttattcaaaccaaatatggtactgtgaatactgaacatatgctgtttataggtgctggagctttccatgtatctaagccgagtgacttgataccagaattgcaaggtcgttttccgattagagttgaacttgatagtttatcggtagaagattttgtaagaattttgacagaaccaaaattgtcattaattaaacaatatgaagcattgcttcaaacagaagaagttactgtaaactttaccgatgaagcaattactcgcttagctgagattgcttatcaagtaaatcaagatacagacaacattggtgcacgtcgacttcatacaattttagaaaagatgctagaagatttatcattcgaagcaccaagtatgccgaatgcagttgtagatattaccccacaatatgttgatgataaattaaaatcaatttcaacaaataaagatttaagtgcatttattcta

SEQ ID NO: 4774 - protein, 470 aa, Staphylococcus aureus
  MISC_FEATURE (1)..(470): heat shock protein HslU
MKLMDTAGIRLTPKEIVSKLNEYIVGQNDAKRKVAIALRNRYRRSLLDEESKQEISPKNILMIGPTGVGKTEIARRMAKVVGAPFIKVEATKFTEVGYVGRDVESMVRDLVDVSVRLVKAQKKSLVQDEATAKANEKLVKLLVPSMKKKASQTNNPLESLFGGAIPNFGQNNEDEEEPPTEEIKTKRSEIKRQLEEGKLEKEKVRIKVEQDPGALGMLGTNQNQQMQEMMNQLMPKKKVEREVAVETARKILADSYADELIDQESANQEALELAEQMGIIFIDEIDKVATNNHNSGQDVSRQGVQRDILPILEGSVIQTKYGTVNTEHMLFIGAGAFHVSKPSDLIPELQGRFPIRVELDSLSVEDFVRILTEPKLSLIKQYEALLQTEEVTVNFTDEAITRLAEIAYQVNQDTDNIGARRLHTILEKMLEDLSFEAPSMPNAVVDITPQYVDDKLKSISTNKDLSAFIL

SEQ ID NO: 4775 - DNA, 543 bp, Staphylococcus aureus
atgagtaatacaacattacatgcaacaacaatttatgctgtaagacataatgggaaagcagctatggctggagatgggcaagtaacgcttggtcaacaagtcatcatgaaacaaacggcaagaaaagtgcgacgtttatatgaaggtaaagtgttagctggtttcgcaggtagtgtagcagatgcgtttacgttatttgaaaaattcgaaacaaaattacaacagtttagtggtaacttagaaagagctgctgttgaattggcacaagaatggcgaggcgataaacaattacgtcaattagaagctatgctaattgtaatggataaagatgctattttagttgtcagtggaactggcgaagttattgctccagatgatgaccttatcgctattggatcaggaggcaactacgcattaagcgcaggacgtgcattgaaacgccatgcatcgcatttgtctgctgaagaaatggcatatgagagcttgaaagtagcggctgatatttgtgtctttaccaacgataatattgttgtcgaaacacta

SEQ ID NO: 4776 - protein, 181 aa, Staphylococcus aureus
  MISC_FEATURE (1)..(181): heat shock protein HslV
MSNTTLHATTIYAVRHNGKAAMAGDGQVTLGQQVIMKQTARKVRRLYEGKVLAGFAGSVADAFTLFEKFETKLQQFSGNLERAAVELAQEWRGDKQLRQLEAMLIVMDKDAILVVSGTGEVIAPDDDLIAIGSGGNYALSAGRALKRHASHLSAEEMAYESLKVAADICVFTNDNIVVETL

SEQ ID NO: 4777 - DNA, 894 bp, Staphylococcus aureus
ttgaatcatattcaagatgcgtttttaaatacattgaaagttgaacggaatttttcggaacacacattgaaatcatatcaagatgacttaattcagtttaatcaatttttagaacaagaacatttagagttgaatacttttgaatacagagatgctagaaattatttgagctatttatattcaaatcatttgaaaagaacatctgtttctcgtaaaatctcaacgttaagaactttctatgaatattggatgacgcttgatgagaacattattaatccatttgttcaattagtacatccgaaaaaagaaaaatatcttccgcaattcttttacgaagaagaaatggaagcgttattcaaaactgtagaagaggacacttcaaaaaatttacgggatcgagttattcttgaattgttgtatgctacaggcatccgtgtttcggaattagtaaatattaaaaaacaagatatagatttttacgcgaatggtgttaccgtattaggaaaagggagcaaagagcgctttgtaccgtttggtgcttattgtagacaaagcatcgaaaattatttagaacatttcaaaccaattcagtcatgcaatcatgattttcttattgtaaatatgaagggtgaagcaatcactgaacgcggtgtacgatatgttttaaatgatattgttaaacgaacagcaggcgtaagtgagattcatccccacaagctcagacatacatttgcaacgcatttattgaatcaaggtgcagacctaagaacagtacaatcgttattaggtcatgttaatttgtcaacaactggtaaatatacacacgtatctaaccaacaattaagaaaagtgtatctaaatgcacatcctcgagcgaaaaaggagaatgaaaca

SEQ ID NO: 4778 - protein, 298 aa, Staphylococcus aureus
  MISC_FEATURE (1)..(298): site-specific recombinase
LNHIQDAFLNTLKVERNFSEHTLKSYQDDLIQFNQFLEQEHLELNTFEYRDARNYLSYLYSNHLKRTSVSRKISTLRTFYEYWMTLDENIINPFVQLVHPKKEKYLPQFFYEEEMEALFKTVEEDTSKNLRDRVILELLYATGIRVSELVNIKKQDIDFYANGVTVLGKGSKERFVPFGAYCRQSIENYLEHFKPIQSCNHDFLIVNMKGEAITERGVRYVLNDIVKRTAGVSEIHPHKLRHTFATHLLNQGADLRTVQSLLGHVNLSTTGKYTHVSNQQLRKVYLNAHPRAKKENET

SEQ ID NO: 4779 - DNA, 1305 bp, Staphylococcus aureus
atgactcaaactgtaaatgtaataggtgctggtcttgccggttcagaagcggcatatcaattagctgaaagaggaattaaagttaatctaatagagatgagacctgttaaacaaacaccagcgcaccatactgataaatttgcggaacttgtatgttccaattcattacgcggaaatgctttaactaatggtgtgggtgttttaaaagaagaaatgagaagattgaattctataattattgaagcggctgataaggcacgagttccagctggtggtgcattagcagttgatagacacgatttttcaggttatattactgaaacacttaaaaatcatgaaaatatcacagttattaatgaagaaattaatgccattccagatggatacacaattatcgcaacaggaccacttactacagaaacccttgcgcaagaaatagtggacattactggtaaagatcaactttatttctatgatgcggctgctccaattattgaaaaagaatctattgatatggataaagtttacttaaagtcccgttatgataaaggtgaagctgcatatttaaactgtcctatgactgaggatgaatttaatcgcttttatgatgcagtattagaagctgaagttgcgcctgtaaattcatttgaaaaagaaaaatatttcgagggttgtatgccttttgaagtaatggcagaacgcggacgcaagacattactatttggaccaatgaaaccagtaggattagaagatccaaagactgggaaacgtccttatgcggtggttcaattaagacaagatgacgctgctggtacactctacaatattgttggcttccaaacgcatttaaaatggggagctcaaaaagaagtcattaaattaattccaggcttagaaaatgttgatattgttagatatggtgtgatgcatagaaataccttcattaattcaccggacgtattaaacgagaaatatgaattgatttcacaaccaaacatacagtttgcgggacaaatgactggtgttgaaggttatgtagaaagcgcagctagcggcttagttgcaggtatcaatcttgcgcataaaatattaggcaagggtgaggtagtatttccgagagaaacaatgattggaagtatggcttactatatttctcatgctaaaaacaataagaatttccaacctatgaatgctaacttcgggttattaccatctttagaaactagaattaaagataaaaaagaacgctatgaagcacaagctaatagagctttggattacttagaaaatttcaaaaaaacttta

SEQ ID NO: 4780 - protein, 435 aa, Staphylococcus aureus
  MISC_FEATURE (1)..(435): glucose-inhibited division
MTQTVNVIGAGLAGSEAAYQLAERGIKVNLIEMRPVKQTPAHHTDKFAELVCSNSLRGNALTNGVGVLKEEMRRLNSIIIEAADKARVPAGGALAVDRHDFSGYITETLKNHENITVINEEINAIPDGYTIIATGPLTTETLAQEIVDITGKDQLYFYDAAAPIIEKESIDMDKVYLKSRYDKGEAAYLNCPMTEDEFNRFYDAVLEAEVAPVNSFEKEKYFEGCMPFEVMAERGRKTLLFGPMKPVGLEDPKTGKRPYAVVQLRQDDAAGTLYNIVGFQTHLKWGAQKEVIKLIPGLENVDIVRYGVMHRNTFINSPDVLNEKYELISQPNIQFAGQMTGVEGYVESAASGLVAGINLAHKILGKGEVVFPRETMIGSMAYYISHAKNNKNFQPMNANFGLLPSLETRIKDKKERYEAQANRALDYLENFKKTL

SEQ ID NO: 4781 - DNA, 1248 bp, Staphylococcus aureus
atgagcttttttaaacgcttaaaagataagtttgcaacaaataaagaaaatgaagaagttaaatccttaacagaagaacaaggtcaagacaaattagaagatacacattctgaaggttcaacgcaggacgcaaatgatttagcagaaaatgctgaagtgaaaaagaagccacgcaagttgagtgaagcggattttgatgacgatggcttaatatcaattgaagattttgaagaaattgaagctcaaaaaatgggtgctaaatttaaagcaggactcgaaaaatctcgtcaaaatttccaagaacaattaaataatttgatagcgagatatcgtaaagtagatgaagacttttttgaagctttagaagaaatgttaatcactgcagacgtcggttttaatacagtgatgacgttaactgaagaattacgtatggaagcacaacgacgtaatattcaagatactgaagatttgcgtgaagtcattgttgaaaagatcgtagagatttaccatcaagaagatgataattcagaagctatgaacttagaagatggtcgtttaaatgtcattttaatggttggtgtgaatggtgttggtaaaacaacaacaattggaaaattagcttaccgatataaaatggaaggtaaaaaagtaatgttagctgcgggcgatacttttagagcgggtgctattgatcaattgaaagtttggggcgaacgtgttggtgtagacgtaattagccaaagtgaaggttctgatccagctgctgttatgtatgatgcgattaatgccgctaaaaacaaaggtgttgatattttaatctgtgataccgctggacgtttacaaaataaaacaaatctaatgcaagaattagaaaaagttaagcgtgtaattaatcgagcagtgccagatgcgcctcatgaagcattactatgtttagatgctacaactggtcagaatgcgttgtcacaagctagaaactttaaagaagtaacaaatgttacaggtattgtattaacgaaattagatggtacagccaaaggtggtatcgtattagccattcgtaatgaattgcacatcccagttaaatatgtaggtttaggtgagcaattagatgacttacaaccatttaaccctgaaagttatgtctacggcttattcgctgatatgattgaacaaaatgaagaaataacaacagttgaaaatgatcaaattgtaacagaagaaaaggacgataatcatgggtcaaaa

SEQ ID NO: 4782 - protein, 416 aa, Staphylococcus aureus
  MISC_FEATURE (1)..(416): signal recognition particle
MSFFKRLKDKFATNKENEEVKSLTEEQGQDKLEDTHSEGSTQDANDLAENAEVKKKPRKLSEADFDDDGLISIEDFEEIEAQKMGAKFKAGLEKSRQNFQEQLNNLIARYRKVDEDFFEALEEMLITADVGFNTVMTLTEELRMEAQRRNIQDTEDLREVIVEKIVEIYHQEDDNSEAMNLEDGRLNVILMVGVNGVGKTTTIGKLAYRYKMEGKKVMLAAGDTFRAGAIDQLKVWGERVGVDVISQSEGSDPAAVMYDAINAAKNKGVDILICDTAGRLQNKTNLMQELEKVKRVINRAVPDAPHEALLCLDATTGQNALSQARNFKEVTNVTGIVLTKLDGTAKGGIVLAIRNELHIPVKYVGLGEQLDDLQPFNPESYVYGLFADMIEQNEEITTVENDQIVTEEKDDNHGSK

SEQ ID NO: 4783 - DNA, 351 bp, Staphylococcus aureus
atggaagcaaaagcggttgctagaacaataagaatcgcacctcgtaaagtaagactagttcttgacttaatcagaggtaaaaatgctgctgaagctattgcaattttaaaattaacaaacaaagcttcatcaccagtaattgaaaaagtattaatgtccgctttagctaatgctgaacataactatgacatgaacacagatgaattagtagttaaagaagcatatgctaacgaaggaccaacattaaaacgtttccgtccacgtgcgcaaggtcgtgcaagtgcgattaacaaacgtacaagccacattacaatcgtcgtaagtgacggtaaagaagaagctaaagaagct

SEQ ID NO: 4784 - protein, 117 aa, Staphylococcus aureus
  MISC_FEATURE (1)..(117): 50S ribosomal protein L22
MEAKAVARTIRIAPRKVRLVLDLIRGKNAAEAIAILKLTNKASSPVIEKVLMSALANAEHNYDMNTDELVVKEAYANEGPTLKRFRPRAQGRASAINKRTSHITIVVSDGKEEAKEA

SEQ ID NO: 4785 - DNA, 2073 bp, Staphylococcus aureus
atgacattggcagataatttagtcattgttgaatcgcctgcaaaagcaaaaaccattgaaaagtatttaggtaagaaatataaagttatagcttcaatgggacacgtcagagacttaccaagaagtcaaatgggtgtcgacactgaagataattacgaaccaaaatatataacaatacgcggaaaaggtcctgttgtaaaagaattgaaaaaacatgcaaaaaaagcgaaaaacgtctttctcgcaagtgaccccgaccgtgaaggtgaagcaattgcttggcatttatcaaaaattttagagcttgaagattctaaagaaaatcgcgttgttttcaacgaaataactaaagacgctgttaaagaaagttttaaaaatcctagagaaattgaaatgaacttagtcgatgcacaacaagcgcgtcgaatattagatagattagttggctataacatctcgccagttctttggaaaaaagtaaaaaaagggttgtcagcgggtcgagttcaatctgttgcacttcgtttagtcattgaccgtgaaaatgaaattcgaaactttaaaccagaagaatattggactattgaaggagaatttagatacaaaaaatcaaaattcaatgctaaattccttcattataaaaataaaccttttaaactaaaaacgaaaaaagatgttgagaaaattacagctgcattagatggagatcaattcgaaattacaaacgtgactaaaaaagaaaaaacgcgtaatccagcaaacccatttacaacttctacattacaacaagaggcggcacgtaaattaaactttaaagcaagaaaaacaatgatggtcgcacaacaattatatgaaggtatagatttgaaaaaacaaggtacgattggtttaataacatatatgagaaccgattctacacgtatttcagatactgccaaagttgaagcaaaacagtatataactgataaatacggtgaatcttacacttctaaacgtaaagcatcagggaaacaaggtgaccaagatgcccatgaggctattagaccttcaagtactatgcgtacgccagatgatatgaagtcatttttgacgaaagaccaataccgattatacaaattaatttgggaacgatttgttgctagtcaaatggctccagcaatacttgatacagtctcattagacataacacaaggtgacattaaatttagagcgaatggtcaaacaatcaagtttaaaggatttatgacactttatgtagaaactaaagatgatagtgatagcgaaaaggaaaataaactgcctaaattagagcaaggtgataaagtcacagcaactcaaattgaaccagctcaacactatacacaaccacctccaagatatactgaggcgagattagtaaaaacactagaagaattgaaaattgggcgaccatcaacttatgcaccgacaatagatacgattcaaaagcgtaactatgtcaaattagaaagtaagcgttttgttcctactgagttgggagaaatagttcatgaacaagtgaaagaatacttcccagagattattgatgtggaattcacagtgaatatggaaacgttacttgataagattgcagaaggcgacattacatggaggaaagtaatcgacggtttctttagtagctttaaacaagatgttgaacgtgctgaagaagagatggaaaagattgaaatcaaagatgagccagccggtgaagactgtgaaatttgtggttctcctatggttataaaaatgggacgctatggtaagttcatggcttgctcaaacttcccggattgtcgtaatacaaaagcgatagttaagtctattggtgttaaatgtccaaaatgtaatgatggtgacgtcgtagaaagaaaatctaaaaagaatcgtgtcttttatggatgttcgaaatatcctgaatgcgactttatctcttgggataagccgattggaagagattgtccaaaatgtaaccaatatcttgttgaaaataaaaaaggcaagacaacacaagtaatatgttcaaattgcgattataaagaggcagcgcagaaa

SEQ ID NO: 4786 - protein, 691 aa, Staphylococcus aureus
  MISC_FEATURE (1)..(691): DNA topoisomerase I topA
MTLADNLVIVESPAKAKTIEKYLGKKYKVIASMGHVRDLPRSQMGVDTEDNYEPKYITIRGKGPVVKELKKHAKKAKNVFLASDPDREGEAIAWHLSKILELEDSKENRVVFNEITKDAVKESFKNPREIEMNLVDAQQARRILDRLVGYNISPVLWKKVKKGLSAGRVQSVALRLVIDRENEIRNFKPEEYWTIEGEFRYKKSKFNAKFLHYKNKPFKLKTKKDVEKITAALDGDQFEITNVTKKEKTRNPANPFTTSTLQQEAARKLNFKARKTMMVAQQLYEGIDLKKQGTIGLITYMRTDSTRISDTAKVEAKQYITDKYGESYTSKRKASGKQGDQDAHEAIRPSSTMRTPDDMKSFLTKDQYRLYKLIWERFVASQMAPAILDTVSLDITQGDIKFRANGQTIKFKGFMTLYVETKDDSDSEKENKLPKLEQGDKVTATQIEPAQHYTQPPPRYTEARLVKTLEELKIGRPSTYAPTIDTIQKRNYVKLESKRFVPTELGEIVHEQVKEYFPEIIDVEFTVNMETLLDKIAEGDITWRKVIDGFFSSFKQDVERAEEEMEKIEIKDEPAGEDCEICGSPMVIKMGRYGKFMACSNFPDCRNTKAIVKSIGVKCPKCNDGDVVERKSKKNRVFYGCSKYPECDFISWDKPIGRDCPKCNQYLVENKKGKTTQVICSNCDYKEAAQK

SEQ ID NO: 4787 - DNA, 870 bp, Staphylococcus aureus
ttgattaaactatttttgcttaagttatactgggcacacttttcgactaaacaaattcatcaatttttaatggcatatcctaatgtaattaaagaggagggaagaaaaaaagatagttatttatgtgaatgggtgaatagggaagaaaatgttcatttattacgtaaatactatgcttttataaaacttgatcataacgatattattaaagaactgcagaaattaaaagtaagttacattacatatatggattctgaatacccagtgctattaaaagaaatatatcaatttccattacttcttttctataaagggaacatcaaattaataaataatatgcatcatttggcagtagtaggtgcaagagattctacaagttatacccaacagtctttagaatttttattatcaaatgataaaagcaaatatttaacaattgtttccggccttgctcaaggagctgatgcaatggcacatcaaatagctttaaaatacaatctccctacaattgcagttttagcctttggccatcaaacacattatcccaaaagtacattagcattaagaaataaaatagaagaaaaaggtttagttatatctgaatatccaccacatacaccaatcgctaaatatagatttcctgagcgcaatagaattatcagcggtttgtcaaaaggggttttaattactgaggctaaggaacaaagtggcagtcacatcacgatagattttgcattagagcaaaatagaaatgtttatgttttacctggatctatgtttaatcctatgacaaaaggtaatttattacgtatccaagaaggtgctaaggtagtattaaacgctaatgatatatttgaagactactatatt

SEQ ID NO: 4788 - protein, 290 aa, Staphylococcus aureus
  MISC_FEATURE (1)..(290): hypothetical protein
LIKLFLLKLYWAHFSTKQIHQFLMAYPNVIKEEGRKKDSYLCEWVNREENVHLLRKYYAFIKLDHNDIIKELQKLKVSYITYMDSEYPVLLKEIYQFPLLLFYKGNIKLINNMHHLAVVGARDSTSYTQQSLEFLLSNDKSKYLTIVSGLAQGADAMAHQIALKYNLPTIAVLAFGHQTHYPKSTLALRNKIEEKGLVISEYPPHTPIAKYRFPERNRIISGLSKGVLITEAKEQSGSHITIDFALEQNRNVYVLPGSMFNPMTKGNLLRIQEGAKVVLNANDIFEDYYI

SEQ ID NO: 4789 - DNA, 1242 bp, Staphylococcus aureus
atgaaattttcaactttaagtgaagaagaatttaccaactacaccaaaaagcacttcaaacattatacgcagtctatagaattatataattatagaaataaaataaatcatgaagcacatattgtgggagtgaagaatgataaaaatgaagttatagctgcatgtttattaacagaggcacgaatttttaaattctacaaatatttctactctcatagaggtcctttacttgattatttcgatgctaaattagtttgttacttttttaaagaattatctaaattcatttataaaaatagaggagtatttattcttgttgatccatatttaatagagaatttaagagatgcaaatggtaggataataaagaattataataattcagtgatagtaaagatgctagggaaaattgggtatctccatcaaggttatacaacaggatattcaaataaaagtcaaattaggtggatttctgtattggatttaaaagataaagatgagaatcaacttttaaaagaaatggaataccaaactagaagaaatataaaaaagactattgagattggtgttaaggttgaagatttatctattgaagaaacaaatcgattttataaattgtttcaaatggctgaagaaaaacatggttttcatttcatgaatgaagattattttaaacgaatgcaagaaatatataaagataaggcaatgttaaagatagcttgtataaatcttaatgaatatcaagataaattaaaaatacaattattgaaaatcgaaaatgaaatgatgactgtgaacagagcattaaatgaaaatccaaattctaaaaaaaataaatcaaaattaaatcagttaaatatgcaattatctagtattaataatagaattagtaaaaccgaagaactaatatttgaagatggacctgttttggatttagctgctgctttatttatatgtactgatgatgaagtttattatctatcaagtggatcaaatccgaaatataatcagtatatgggtgcatatcatctacaatggcatatgataaaatatgcaaaatcacataatattaataggtataatttttatggaataacaggcgtctttagtaatgaggcggatgattttggtgttcaacaatttaaaaagggttttaatgcacatgttgaagaattaattggtgatttcatcaaaccagtaagaccaattctatataaatttgcaaaacttatttataaggtt

SEQ ID NO: 4790 - protein, 414 aa, Staphylococcus aureus
  MISC_FEATURE (1)..(414): FmhC protein
MKFSTLSEEEFTNYTKKHFKHYTQSIELYNYRNKINHEAHIVGVKNDKNEVIAACLLTEARIFKFYKYFYSHRGPLLDYFDAKLVCYFFKELSKFIYKNRGVFILVDPYLIENLRDANGRIIKNYNNSVIVKMLGKIGYLHQGYTTGYSNKSQIRWISVLDLKDKDENQLLKEMEYQTRRNIKKTIEIGVKVEDLSIEETNRFYKLFQMAEEKHGFHFMNEDYFKRMQEIYKDKAMLKIACINLNEYQDKLKIQLLKIENEMMTVNRALNENPNSKKNKSKLNQLNMQLSSINNRISKTEELIFEDGPVLDLAAALFICTDDEVYYLSSGSNPKYNQYMGAYHLQWHMIKYAKSHNINRYNFYGITGVFSNEADDFGVQQFKKGFNAHVEELIGDFIKPVRPILYKFAKLIYKV

SEQ ID NO: 4791 - DNA, 1116 bp, Staphylococcus aureus
atgaataaacaacaaagtaaagtacgctattcaattagaaaagttagtattggaattttgtcaatttcaataggtatgtttttggcattgggtatgtcgaacaaagcatatgcagatgaaattgataaatctaaagattttacaagagggtatgagcaaaatgtattcgcgaaatcagagttaaatgctaataaaaatacgacaaaagacaaaataaaaaatgaaggtgctgttaaaacatcggacacaagtttaaagttagacaacaaatcagcaatttcaaacggaaatgaaattaatcaagatataaagatttcaaatactccgaaaaactcaagccaaggtaacaatctagttattaataacaatgaacttactaaagaaattaaaattgcaaacttggaagctcaaaattctaatcagaagaaaacgaataaagttactaataattactttggttactacagttttagagaagctccaaaaacacaaatctatactgtaaaaaaaggagacacacttagtgctatagcattaaaatacaaaactacagtttcaaatattcaaaatacaaataatatagcaaatcctaatttaatatttattggtcaaaaattaaaagtgccaatgacaccattagtagaaccaaaaccaaaaacagtgtcttcaaataataaaagtaatagtaatagcagtacattaaattatttgaaaacattagagaatagaggatgggatttcgacggtagttatggatggcaatgtttcgatttagttaatgtatattggaatcatctttatggtcatggattaaaaggatatggagctaaagatataccatatgcaaataattttaatagtgaagctaaaatttatcacaacacaccaactttcaaagctgaacctggggacttagtggtttttagtggaagatttggtggaggatatggtcatacagctattgtcttaaatggtgattatgatggaaaattaatgaagttccaaagtttagatcaaaactggaataatggtggatggcgtaaagcagaggttgcacataaagttgttcataattatgaaaatgatatgatttttattagaccatttaaaaaagca

SEQ ID NO: 4792 - protein, 372 aa, Staphylococcus aureus
  MISC_FEATURE (1)..(372): LytN protein
MNKQQSKVRYSIRKVSIGILSISIGMFLALGMSNKAYADEIDKSKDFTRGYEQNVFAKSELNANKNTTKDKIKNEGAVKTSDTSLKLDNKSAISNGNEINQDIKISNTPKNSSQGNNLVINNNELTKEIKIANLEAQNSNQKKTNKVTNNYFGYYSFREAPKTQIYTVKKGDTLSAIALKYKTTVSNIQNTNNIANPNLIFIGQKLKVPMTPLVEPKPKTVSSNNKSNSNSSTLNYLKTLENRGWDFDGSYGWQCFDLVNVYWNHLYGHGLKGYGAKDIPYANNFNSEAKIYHNTPTFKAEPGDLVVFSGRFGGGYGHTAIVLNGDYDGKLMKFQSLDQNWNNGGWRKAEVAHKVVHNYENDMIFIRPFKKA

SEQ ID NO: 4793 - DNA, 906 bp, Staphylococcus aureus
atgagtgtatttatagataagaatactaaagtaatggtacaaggtattacagggtctactgcccttttccatacaaaacaaatgcttgattatggtacgaaaatagtagcaggtgtgacgcctggtaaaggtggtcaagttgttgaaggcgttcctgttttcaacactgttgaagaagctaaaaatgaaactggggcaacggtttcagtcatttacgttccagcaccatttgctgcagactcaattttagaagcagctgatgcagacttagatatggttatttgtatcactgaacatattcctgtattagacatggttaaagttaaacgctacttacaaggtagaaaaacacgtttagttggtccgaactgtccaggtgtgattacagcagatgaatgtaaaattggtattatgcctggctatattcacaaaaaaggtcatgttggtgtagtatctcgttcaggtacattaacatatgaagcagtgcaccaattgactgaagaaggtattggtcaaactacagctgttggtattggtggagacccagtcaacggaacaaactttattgatgttttaaaagcattcaatgaagatgacgaaacgaaagcagttgttatgattggtgaaatcggtggtacggctgaagaagaagcagctgaatggattaaagcgaatatgacaaaaccagttgtaggctttatcggtggacaaacagcacctcctggaaaacgtatgggacatgctggtgcaatcatttcaggtggtaaaggtactgctgaagagaaaattaaaacattaaatagttgtggtgtgaaaacagcggcaacaccttcagaaattggttcaacattaattgaagctgctaaagaagcaggtatttatgaatcattattaactgttaataaa

SEQ ID NO: 4794 - protein, 302 aa, Staphylococcus aureus
  MISC_FEATURE (1)..(302): succinyl-CoA synthetase
MSVFIDKNTKVMVQGITGSTALFHTKQMLDYGTKIVAGVTPGKGGQVVEGVPVFNTVEEAKNETGATVSVIYVPAPFAADSILEAADADLDMVICITEHIPVLDMVKVKRYLQGRKTRLVGPNCPGVITADECKIGIMPGYIHKKGHVGVVSRSGTLTYEAVHQLTEEGIGQTTAVGIGGDPVNGTNFIDVLKAFNEDDETKAVVMIGEIGGTAEEEAAEWIKANMTKPVVGFIGGQTAPPGKRMGHAGAIISGGKGTAEEKIKTLNSCGVKTAATPSEIGSTLIEAAKEAGIYESLLTVNK

SEQ ID NO: 4795 - DNA, 1164 bp, Staphylococcus aureus
atgaatatccacgagtatcaaggtaaagaaatatttcgttcaatgggcgttgcagttccagaaggacgagtagcatttactgctgaagaagcggtggagaaagcaaaagaattaaattctgatgtttatgttgtaaaagcacaaattcatgctggaggtagaggtaaagcaggcggagtaaaaattgctaaatctttatctgaggtagaaacatatgcaaaagaattattagggaaaactttggtgacacatcaaactggtccagaaggtaaagaaattaagcgtttatatatcgaagaaggttgtgctattcaaaaagaatattacgttggattcgttattgatcgtgcgactgaccaagtaacattgatggcgtctgaagaagggggcactgagattgaagaagttgctgcgaagactcctgaaaagatcttcaaagaaactatcgatccagtaatcggactttcaccattccaagcaagacgaattgcgtttaatattaatattcctaaagaatctgttaacaaagctgctaaattcttattagcactttataatgtattcattgaaaaagattgttcaatcgtagaaatcaacccattagttacaacagctgatggtgatgtattggcattagatgctaaaattaattttgatgataatgcattattcagacataaagatgttgtagaattacgtgatttagaagaagaagatccgaaagagattgaagcgtctaaacatgatttatcatacattgcattagatggtgacatcggatgtatggttaatggtgcaggtttagccatggcaacaatggatacgattaatcatttcggtggaaacccagccaatttcttagatgcaggcggaagcgctactagagaaaaagtaactgaagcatttaaaatcattttaggtgatgaaaatgttaaaggtatttttgtaaacattttcggtggcattatgaaatgtgatgttatcgcagaaggtatcgttgaagctgtaaaagaagtagatttaactttaccactagttgtacgcctagaaggtacaaatgttgagttaggtaaaaaaatcttaaaagactcaggattagcaattgaaccagcagcaacaatggctgaaggtgcacaaaaaattgttaaactagtcaaagaagca

SEQ ID NO: 4796 - protein, 388 aa, Staphylococcus aureus
  MISC_FEATURE (1)..(388): succinyl-CoA synthetase
MNIHEYQGKEIFRSMGVAVPEGRVAFTAEEAVEKAKELNSDVYVVKAQIHAGGRGKAGGVKIAKSLSEVETYAKELLGKTLVTHQTGPEGKEIKRLYIEEGCAIQKEYYVGFVIDRATDQVTLMASEEGGTEIEEVAAKTPEKIFKETIDPVIGLSPFQARRIAFNINIPKESVNKAAKFLLALYNVFIEKDCSIVEINPLVTTADGDVLALDAKINFDDNALFRHKDVVELRDLEEEDPKEIEASKHDLSYIALDGDIGCMVNGAGLAMATMDTINHFGGNPANFLDAGGSATREKVTEAFKIILGDENVKGIFVNIFGGIMKCDVIAEGIVEAVKEVDLTLPLVVRLEGTNVELGKKILKDSGLAIEPAATMAEGAQKIVKLVKEA

SEQ ID NO: 4797 - DNA, 765 bp, Staphylococcus aureus
atgacgctaacaattaaagaagttacgcagttgattaatgcggttaatacaatagaagaattagaaaatcatgaatgctttttagatgagcgaaaaggtgttcaaaatgccatagctaggcgcagaaaagcgttagaaaaagaacaagctttaaaagaaaagtatgttgaaatgacttactttgaaaatgaaatattaaaagagcatcctaatgctattatttgtgggattgatgaagttggaagaggacctttagcaggtccagtcgttgcatgcgcaacaattttaaattcaaatcacaattatttgggccttgatgactcgaaaaaagtacctgttacgaaacgtctagaattaaatgaagcactaaaaaatgaagttactgcttttgcatatgggatcgcgacagctgaagaaatagatgaatttaatatttataaagctactcaaatcgccatgcagcgagctattgatggattatcagtacaaccaacgcatttattgatagacgcgatgacgcttgataatgcactgcctcaagtatctttaatcaagggtgatgcaagaagtgtgtccattgcagctgcaagtatcatggcaaaggtttttcgtgatgattatatgacacagttatctaaagattatcctgaatatggttttgaaaaaaacgcgggttacggtaccaaacaacatttactagcaatcgatgatattggcattatgaaagagcatagaaaaagctttgaacctataaaatcgttactg

SEQ ID NO: 4798 - protein, 255 aa, Staphylococcus aureus
  MISC_FEATURE (1)..(255): RNase HII [Staphylococcus
MTLTIKEVTQLINAVNTIEELENHECFLDERKGVQNAIARRRKALEKEQALKEKYVEMTYFENEILKEHPNAIICGIDEVGRGPLAGPVVACATILNSNHNYLGLDDSKKVPVTKRLELNEALKNEVTAFAYGIATAEEIDEFNIYKATQIAMQRAIDGLSVQPTHLLIDAMTLDNALPQVSLIKGDARSVSIAAASIMAKVFRDDYMTQLSKDYPEYGFEKNAGYGTKQHLLAIDDIGIMKEHRKSFEPIKSLL

SEQ ID NO: 4799 - DNA, 882 bp, Staphylococcus aureus
atggttattcaatggtatccaggacatatggcgaaagccaaaagagaagtaagtgaacaattaaaaaaagtagatgtagtgtttgaactagtagatgcaagaattccatatagttcaagaaaccctatgatagatgaagttattaaccaaaaaccacgtgttgttatattaaataaaaaagatatgtctaatttaaatgagatgtcaaaatgggaacaattttttattgataaaggatactatcctgtatcagtggatgctaagcacggtaaaaatttaaagaaagtggaagctgcagcaattaaggcgactgctgaaaaatttgaacgcgaaaaagcgaaaggacttaaacctagagcgataagagcaatgatcgttggaattccaaatgttggtaaatccacattaataaataaactggcaaagcgtagtattgcgcagactggtaataaaccaggtgtgaccaaacaacaacaatggattaaagttggtaatgcattacaactattagacacaccagggatactttggcctaaatttgaagatgaagaagtcggtaagaagttgagtttaactggtgcgataaaagatagtattgtgcacttagatgaagttgccatctatggattaaactttttaattcaaaatgatttagcgcgattaaagtcacattataatattgaagttcctgaagatgcagaaatcatagcgtggtttgatgcgatagggaaaaaacgtggcttaattcgacgtggtaatgaaattgattacgaagcagtcattgaactgattatttatgatattcgaaatgctaaaataggaaattattgttttgatatttttaaagatatgactgaggaattagcaaatgacgctaacaat

SEQ ID NO: 4800 - protein, 294 aa, Staphylococcus aureus
  MISC_FEATURE (1)..(294): conserved hypothetical
MVIQWYPGHMAKAKREVSEQLKKVDVVFELVDARIPYSSRNPMIDEVINQKPRVVILNKKDMSNLNEMSKWEQFFIDKGYYPVSVDAKHGKNLKKVEAAAIKATAEKFEREKAKGLKPRAIRAMIVGIPNVGKSTLINKLAKRSIAQTGNKPGVTKQQQWIKVGNALQLLDTPGILWPKFEDEEVGKKLSLTGAIKDSIVHLDEVAIYGLNFLIQNDLARLKSHYNIEVPEDAEIIAWFDAIGKKRGLIRRGNEIDYEAVIELIIYDIRNAKIGNYCFDIFKDMTEELANDANN

SEQ ID NO: 4801 - DNA, 2625 bp, Staphylococcus aureus
ttgaaagttgaggataatgttgtgttaaaaaagtggctaaattcaaacgtcaaacaattctttgttataactttcattagtgtaatattaacgcttattttattttctactcatatctatgattatattgtgaatggtactgtttttagcggggctggagatggattccgtcaaatgatgccatttcaaatgtatttgtatgaacatctacgtagtttttctagtttatatgatgcatcgtttggattaggtggcgattatatgaaaggactatcatattattattcgctgtcacctttaatgtggctaaattttctattcattaaaataggagaaacggttggtatatttaatccgacgacaatacatttttggccgacaaaccaacttattatggctatgatacgagctatcataacatttgtcgtgaccttctacttatttaaaatattacactttaaacgctcagcaaatatgatcgctacgattttatacggcatgtcaactgtcgttatatactttaattttacttggtcattttatggaaatttattatatttattgccattatcgattcttggtttggaaagatattttcaacaacgcaaaatcggtattttcattgttgcgatagccttaacactatttagcaatttttatttcagttattatcaagctattattataggttgctactatttatatcgactcattttcacttacaaatatgacattgtctctagaacacaaaaattaatttgcgtcatatctgctacagttttgagtgtgttatcaagtgtatttggtttattcactggcatttctgcgtttttggaaaatgacagaaagcaaaatcccaatgttgatataccgtttttgacaccacttgattatcattattttttctttagcgatggattttatattacgatttcaattcttactatcgttgcattattgtcattcaaactgtatcgtttttacttttatagacttttcgcaatagtaacatggatattatttataggttcattatcacagtatttcgacagtgcttttaatggtttttcatttccagaaaggcgttgggtgtatatcttagcactatcatcaagtgctctttgcggattgtttattcaacatttatcaacattaaatatgaaatattatttaatcagaacaatacccgtatgcatcatcgcaatactttatgtattactatcaccgacacacccacttgcacttatagtaggtattatcctgctaatagtgcttgccgttattttaaaatttagtttatggcgttataaaaaattaaccgttgcaatattagtattaatcgttatgattcaacaaatcgtcattttagataacaacaaaaacatggcaatcaaaccttatcaacaatcattatcaacgttgaaacaacatgattaccatagtaactatgtaaaccagcttataaaaaagataaatcaaaatgcaacaggctcatttaatcgcattgattatatgtcagactatgcattaaattcaccatttatatatcattataatggcatttcattatattctagtatttttaatggagacattttaaaatattatgacaagacactccaaattaatatgccaatcgataaaaacagcacttatagattacttggcaatcgtcaaaatttactatcactttggaatgttaatgatcgaattagagtgaatcatgatgacaacttaccatatggatttaaaattaagtctgaacacaaagacaataaagttcgttggattcattctaaaaataccatccattatccaagtgcacatattacaaataaggtcttttccaataaagaattaaaatctccattagataaagaacaagcaatgttgcaagggattgtttctaacaatattaaagatgttaatacacattttaaagccaataaaaatttactatcagattcaacaattaaattaaatagtgcagcctggcaatctcctacaaaacatttattacaagttaaacaaaataatggtggtctaactgtacagttgccaaaatcagtttctaatcaatttaaagatttgtattttgaaatggatttagaattactttcgccggataaagctcatgatgttaaagtgaatgaatatacacaagaaagaaataaactcacttataaatatcgacgcgttgtaacacccgtaacgatacgcattaaagctccagatagaattagattatcattgcctaaaggtaagtatcgagtaaatttaaaagggatatacggcgaagattataccacgcttaaagacgcttcaaattcattagaagctgtcaaagttagtaagacaaagcatggttatactattactaaaaataaaaattcatctgggtatattgttttgccaacagcatataatcaaggtatgaaagcgacatcaggtgatcaaagtcttaaagttgaacaagtaaatggtgttatgaccggcattaaagcacctaaaaatataacaaagattcaattgagctataccccaccatactattatttacttataacaattactatatttggcattatatgtagtattattttcacgagatgggcaagacaaaaa

SEQ ID NO: 4802 - protein, 875 aa, Staphylococcus aureus
  MISC_FEATURE (1)..(875): conserved hypothetical
LKVEDNVVLKKWLNSNVKQFFVITFISVILTLILFSTHIYDYIVNGTVFSGAGDGFRQMMPFQMYLYEHLRSFSSLYDASFGLGGDYMKGLSYYYSLSPLMWLNFLFIKIGETVGIFNPTTIHFWPTNQLIMAMIRAIITFVVTFYLFKILHFKRSANMIATILYGMSTVVIYFNFTWSFYGNLLYLLPLSILGLERYFQQRKIGIFIVAIALTLFSNFYFSYYQAIIIGCYYLYRLIFTYKYDIVSRTQKLICVISATVLSVLSSVFGLFTGISAFLENDRKQNPNVDIPFLTPLDYHYFFFSDGFYITISILTIVALLSFKLYRFYFYRLFAIVTWILFIGSLSQYFDSAFNGFSFPERRWVYILALSSSALCGLFIQHLSTLNMKYYLIRTIPVCIIAILYVLLSPTHPLALIVGIILLIVLAVILKFSLWRYKKLTVAILVLIVMIQQIVILDNNKNMAIKPYQQSLSTLKQHDYHSNYVNQLIKKINQNATGSFNRIDYMSDYALNSPFIYHYNGISLYSSIFNGDILKYYDKTLQINMPIDKNSTYRLLGNRQNLLSLWNVNDRIRVNHDDNLPYGFKIKSEHKDNKVRWIHSKNTIHYPSAHITNKVFSNKELKSPLDKEQAMLQGIVSNNIKDVNTHFKANKNLLSDSTIKLNSAAWQSPTKHLLQVKQNNGGLTVQLPKSVSNQFKDLYFEMDLELLSPDKAHDVKVNEYTQERNKLTYKYRRVVTPVTIRIKAPDRIRLSLPKGKYRVNLKGIYGEDYTTLKDASNSLEAVKVSKTKHGYTITKNKNSSGYIVLPTAYNQGMKATSGDQSLKVEQVNGVMTGIKAPKNITKIQLSYTPPYYYLLITITIFGIICSIIFTRWARQK

SEQ ID NO: 4803 - DNA, 492 bp, Staphylococcus aureus
atggatcaagaggttactgaaagatttaaagaaactttccatgctattcaaggacattttacagctgtgttcaaacaattgtttggtggaggcgatgcagaattgcaattaactgaagccgattatttaacagctggtattgatattgtggtacaaccaccgggtaaaaagttgcaacatttatcgttactgagtggtggtgagcgtgcattaactgctattgctttactatttgcaattttaaaagtaagatctgcaccttttgttatattagatgaggttgaagctgcactagatgaagcaaatgttattagatacgcaaaatatttaaatgagttatcagacgaaacacaattcattgttattacacaccgtaaaggaacaatggaatttgcagataggttatacggtgtaacaatgcaagaatcaggtgttactaaacttgtgagtgtgaatttaaatacaatagatgatgtgttgaaggaggagcaa

SEQ ID NO: 4804 - protein, 164 aa, Staphylococcus aureus
  MISC_FEATURE (1)..(164): chromosome segregation SMC
MDQEVTERFKETFHAIQGHFTAVFKQLFGGGDAELQLTEADYLTAGIDIVVQPPGKKLQHLSLLSGGERALTAIALLFAILKVRSAPFVILDEVEAALDEANVIRYAKYLNELSDETQFIVITHRKGTMEFADRLYGVTMQESGVTKLVSVNLNTIDDVLKEEQ

SEQ ID NO: 4805 - DNA, 348 bp, Staphylococcus aureus
atgacaaatcacaaattaatcgaagcagtaactaaatcacaattacgtacagacttaccaagtttccgtcctggtgatactttacgtgtacacgtacgtatcattgagggtactcgtgagcgtatccaagtattcgaaggcgttgtaattaaacgtcgtggcggtggcgtttctgaaacgtttacagttcgtaaaatttcatcaggtgttggcgtggaacgtacattcccattacacacaccaaaaattgaaaaaatcgaagttaaacgtcgtggtaaagtacgtcgtgctaaattatattacttacgtagtttacgtggtaaagctgctagaatccaagaaattcgt

SEQ ID NO: 4806 - protein, 116 aa, Staphylococcus aureus
  MISC_FEATURE (1)..(116): 50S ribosomal protein L19
MTNHKLIEAVTKSQLRTDLPSFRPGDTLRVHVRIIEGTRERIQVFEGVVIKRRGGGVSETFTVRKISSGVGVERTFPLHTPKIEKIEVKRRGKVRRAKLYYLRSLRGKAARIQEIR

SEQ ID NO: 4807 - DNA, 105 bp, Staphylococcus aureus
gtgatatctattgcaaacgcattacatttaatgttaagtttcggtatgtttatcgtcactttcattggtatagtagtagcaataataaatttaagcaataaaaaa

SEQ ID NO: 4808 - protein, 35 aa, Staphylococcus aureus
VISIANALHLMLSFGMFIVTFIGIVVAIINLSNKK

SEQ ID NO: 4809 - DNA, 600 bp, Staphylococcus aureus
atgaataaaatctcgaaggctttaacttggtttattataagtttcattatatttcatctcatattatttattatgtggggcgaacaccaagaatactggtatttatatacaggtataatgctaattgctggtatcagttatgtattttatcaaagagatattgaatctaagcggttgcttacatcaattggtgttggtattattacggcaattattttaattatgcttcaacttttattctcacttataacttctaatttaagttatagttcattaattaaagaattagcaagaacaggtgtcaattggaagtggcaaatgttagtaactttactttttgtcattccatgtcacgagttatatatgagaactgttttacaaaaagaattaacacatttttcaataccgaaatgggtagctatattaataactgcaatttgttctagttcattatttatttatttagataattggtggatagtaacatttatatttgttgcacaagtgatattatcattaagttatgagtatactcgacgtatagcaacaacatccgttgcacaaattgtagctattatattgttattaatttttaatgct

SEQ ID NO: 4810 - protein, 200 aa, Staphylococcus aureus
  MISC_FEATURE (1)..(200): hypothetical protein
MNKISKALTWFIISFIIFHLILFIMWGEHQEYWYLYTGIMLIAGISYVFYQRDIESKRLLTSIGVGIITAIILIMLQLLFSLITSNLSYSSLIKELARTGVNWKWQMLVTLLFVIPCHELYMRTVLQKELTHFSIPKWVAILITAICSSSLFIYLDNWWIVTFIFVAQVILSLSYEYTRRIATTSVAQIVAIILLLIFNA

SEQ ID NO: 4811 - DNA, 174 bp, Staphylococcus aureus
atgactgttgcagaagtgggtaacattgttgagtttatggatggattaagaggtcgtgttgaaaaaatcaacgataactctgttattgttgacttaacaattatggaaaattttaatgaccttgatttaccggaaaaaactgttatcaatcataaacgatataagattgttgaa

SEQ ID NO: 4812 - protein, 58 aa, Staphylococcus aureus
  MISC_FEATURE (1)..(58): conserved hypothetical
MTVAEVGNIVEFMDGLRGRVEKINDNSVIVDLTIMENFNDLDLPEKTVINHKRYKIVE

SEQ ID NO: 4813 - DNA, 984 bp, Staphylococcus aureus
atgaaattcattagtaataataatattacagatccaactttaaacttagcaatggaagaatatgttttaaaaaatttaccagcagaagaaagttactttttattttacataaatagaccatctatcattgttggaaagaatcaaaatacgatagaggaagtaaatcagacatatatcgatgctcacaacatcgatgtagtaagaagaatttctggtggtggcgctgtttatcatgatactggcaatttaaactttagttttataacagatgatgatggtaacagtttccacaatttccaaaaattcactgaaccaattgttcaagcattacaatctttaggcgtaaatgctgaattaactggtcgtaacgatattcaagttggacaagcgaaaatctcagggaatgctatggttaaagttaaaaatagaatgtttagtcatggtacgttgatgttaaatagtgatttagacgaagttcagaatgcactaaaagttaatccagctaagattaaatcaaaaggtattaaatctgttcgtaaacgggtagcaaacattcaagaatttttaaatgaccctttagaaattgaagaatttaaaaaaatcatcttgaaaactatctttggagaaactgaagtagaagaatataaattaacggatgaagattgggaaaatattgaaaagttaagtaacgacaaatatagaacttgggaatggaattatggtagaaaccctaaatataactttgaacgcgaggaaaaatttgaaaaaggatttgtacaaattaagtttgatgttaaacgaggtaaaatcgaacatgcaaaaatattcggtgatttctttggtgtcggagatgtcactgatcttgaaaatgcattagttggctgtctacacgactttgagcacatagaagaagcactatcagaatatgatttatatcattatttcggtgacatagatagacatgaattaattagattaatgtca

SEQ ID NO: 4814 - protein, 328 aa, Staphylococcus aureus
  MISC_FEATURE (1)..(328): lipoate-protein ligase
MKFISNNNITDPTLNLAMEEYVLKNLPAEESYFLFYINRPSIIVGKNQNTIEEVNQTYIDAHNIDVVRRISGGGAVYHDTGNLNFSFITDDDGNSFHNFQKFTEPIVQALQSLGVNAELTGRNDIQVGQAKISGNAMVKVKNRMFSHGTLMLNSDLDEVQNALKVNPAKIKSKGIKSVRKRVANIQEFLNDPLEIEEFKKIILKTIFGETEVEEYKLTDEDWENIEKLSNDKYRTWEWNYGRNPKYNFEREEKFEKGFVQIKFDVKRGKIEHAKIFGDFFGVGDVTDLENALVGCLHDFEHIEEALSEYDLYHYFGDIDRHELIRLMS

SEQ ID NO: 4815 - DNA, 225 bp, Staphylococcus aureus
gtggtttctatgaaatacaatactaatgttaaacatacaactttagaagcgtttgtcacaactgtcaatgatttgggtattgaattaattatcaatgaagcacttcgagaggtaagaaaacgacagctcatagaacttatagatgacgcactcgtcaataaagatgaagcagcatttaatcaatatacggcagaatacaaaaatttggaggcatttctcggtgaa

SEQ ID NO: 4816 - protein, 75 aa, Staphylococcus aureus
  MISC_FEATURE (1)..(75): hypothetical protein
VVSMKYNTNVKHTTLEAFVTTVNDLGIELIINEALREVRKRQLIELIDDALVNKDEAAFNQYTAEYKNLEAFLGE

SEQ ID NO: 4817 - DNA, 573 bp, Staphylococcus aureus
ttgcttatgtattctcaaaatatttatgtgatacgcaaaggagacatggttattcgaccagcatttgatgatgacgatcaaagaaacggtagtgaaataattcggtttgacaaaacgcgtattcaaaatccttttaaagtccagaaaatcattgaacgctcttgcaaattttatggtaatacttatcttggcaagaaagcagagacaaaccgcattactggcatttctagtaaaccacctattttactaacaccattatttccaacttattttttcccaacacattctgacagacaaaatgaaaatatttggttaaatatgcattatatcgaaagtattaaagaattaaaaaatcgtaaatgtaaagtgacatttattaataatgaatcaatcattcttcatgtttcataccacagtttatggcatcaatataacaattccattttttactattacatggtagataaacaatctcgcatgatatcaaaaaatcccgaccaaccaatagattataataaagccacattgaatgtgtttgaagcattgacacgctattctttatttgaagataaa

SEQ ID NO: 4818 - protein, 191 aa, Staphylococcus aureus
  MISC_FEATURE (1)..(191): hypothetical protein
LLMYSQNIYVIRKGDMVIRPAFDDDDQRNGSEIIRFDKTRIQNPFKVQKIIERSCKFYGNTYLGKKAETNRITGISSKPPILLTPLFPTYFFPTHSDRQNENIWLNMHYIESIKELKNRKCKVTFINNESIILHVSYHSLWHQYNNSIFYYYMVDKQSRMISKNPDQPIDYNKATLNVFEALTRYSLFEDK

SEQ ID NO: 4819 - DNA, 1512 bp, Staphylococcus aureus
atgatggaaaaaaatgaaaacattaatgtagagattttaactacgtcagatatgcatagtcatttcttaaatggtgattatggttcaaatatttatagagctggtacttatgttaaccaagtaagagcacaaaatcatcgcgtcattttattagatagtggcggaagtttagctggctcgttagcggcctattattatgctattgttgcaccttataaacgacatccaatgataaagttaatgaacagaatgcattatgatgctagcggtgtgagtccaagtgaattcaagtttggtttatcatttttaactcgttcaattgctttggcacgttttccatggttatcagcaaatattgaatacaatgttactaaggagccttatttttcaactccatattgtattaaacattttggtgacttaaaaattgctatcgtaggcgtcacagcagatggtttaatggaaaatgagtattctgaaatggagcaagatgtatctattgaaaagacattagtggcatcaaaacgttggattagatatatccatgaagttgaagagccagattttttgattgtaatttatcatggtggattgaataaaattagtaatagtacgaaaaataaaaaggcaagttcgaatgaagctgaaaaattaatggaagaactcggtgttatagatttaatgattacagctcatcagcatcaaacaatagtaggtcaagatcatgaaacgtattatgttcaggctggtcaagatgccaaagagcttgtacatctttcgattaattttaaaaagagaacaacaacttatgatgttgaaagcattgattctaaagtgattgacttaaatgagtatgaagaggatcaagaattattagatttaacattctatgatagaaaagcagtggcttattggtcacaggaaatcataagtgataaaggtttgatgttatcagtaaatgggttacaagatttagtctgtcaaacacatccattttcgcaattattacatgatgcaattcaccttgcatttgataatgatataacatgtgtccacgtgcctatgaacggagagaaggggttgagtggacagattcgaaatgaagatttgtatcatgcatacccatatccagataagccaatggatatgacaattagtggtcaaaatatcaaagatatattggagtatagttattcacatttagattttgttaacgagcaattaagcttaacaattattgatgaaacgttatgtacaatgtggcaaggattcaattatgagattgatatgaatcaagaacctgggcaacgagtaatgttagatcaaattgatttgactaagagttatagagttacaatgactgactattgttatcgtaactacaagaattatttaaaaaatgctattatacatgaatcatacgatgaaacaatgagtacattaattgcagagaagttaagagatccgaattatcgtatttcatgtagtgataattttatagttaaaaacagg

SEQ ID NO: 4820 - protein, 504 aa, Staphylococcus aureus
  MISC_FEATURE (1)..(504): hypothetical protein
MMEKNENINVEILTTSDMHSHFLNGDYGSNIYRAGTYVNQVRAQNHRVILLDSGGSLAGSLAAYYYAIVAPYKRHPMIKLMNRMHYDASGVSPSEFKFGLSFLTRSIALARFPWLSANIEYNVTKEPYFSTPYCIKHFGDLKIAIVGVTADGLMENEYSEMEQDVSIEKTLVASKRWIRYIHEVEEPDFLIVIYHGGLNKISNSTKNKKASSNEAEKLMEELGVIDLMITAHQHQTIVGQDHETYYVQAGQDAKELVHLSINFKKRTTTYDVESIDSKVIDLNEYEEDQELLDLTFYDRKAVAYWSQEIISDKGLMLSVNGLQDLVCQTHPFSQLLHDAIHLAFDNDITCVHVPMNGEKGLSGQIRNEDLYHAYPYPDKPMDMTISGQNIKDILEYSYSHLDFVNEQLSLTIIDETLCTMWQGFNYEIDMNQEPGQRVMLDQIDLTKSYRVTMTDYCYRNYKNYLKNAIIHESYDETMSTLIAEKLRDPNYRISCSDNFIVKNR

SEQ ID NO: 4821 - DNA, 1365 bp, Staphylococcus aureus
gtgaacaacgtgtcaatttttagccagtttttaaaaagatcaagccctcaacaaggtattgtattgtactatatcgtcgcaattgtcattgcatttttattattaaacttaccgtatgttcataaaccaggtgtagaagtaaatccaattgacacattatttgttgccgtatccggaattagtgttactggattgtctccgataagtattgtcgatacctattctacatttggacaattaattatcctcgtgatattaaatattggtggaattggcgtcatggcaattggtacgatgttatgggtggtactaggtaaacatattggaattagagaacgtcagttaattatgttagataataacaaaaacacaatgagtggtaccgtcaaattgattattgatattgtaaaatcaatatttgtaatcgaactcgtaggagccatgttattagcattttacttttatcgagataatccagatttaaaatatgcaatcatgcaaggtgtttttgtttctatttctgccactaccaatggtggattagatattacaggtaagtcattaattccttatgcacatgattattttgtacaagcgatagttatatttttaataattttaggatcaatcggcttcccagtattattagaagttaaagcttatattcaaaatagggttactaattttagattttcattatttactaaaattacgacatcaacatatttattcctatttattgttggggtattagccattctattatttgaacataaccatgcgttcaaaggtttaagttggcatcaatcgttattctattcgctgtttcaatcagcgactacaagaagtgcgggtcttcaaacaattgatgtgacaacactaagtgaccccactaatattatcatgggtattttaatgtttataggatcttcgccaagttcggttggtggcggtattcgtacaacaactttcgctattttaattttgtttttaattaactttagtaataatgccgataaaacatccattaaagtttacaatagagaagtacacattatggatattcaacgttcatttgcagtatttacaatggcgacaattttaacatttttaggaatgctaattatatcagctactgaaaatggtaagcttacatttttacaagtattttttgaagtcatgtctgcatttggaacttgtggactatcgcttggtgtcacaagtgatattagtgatatttctaaggtcgtactaatgatactcatgtttataggacgtgttggcttaatatcatttatcattatgatagcaggacgtcgagaaccagataaattccattatccaaaagaacgtattcaaatagga

SEQ ID NO: 4822 - protein, 455 aa, Staphylococcus aureus
  MISC_FEATURE (1)..(455): hypothetical protein
VNNVSIFSQFLKRSSPQQGIVLYYIVAIVIAFLLLNLPYVHKPGVEVNPIDTLFVAVSGISVTGLSPISIVDTYSTFGQLIILVILNIGGIGVMAIGTMLWVVLGKHIGIRERQLIMLDNNKNTMSGTVKLIIDIVKSIFVIELVGAMLLAFYFYRDNPDLKYAIMQGVFVSISATTNGGLDITGKSLIPYAHDYFVQAIVIFLIILGSIGFPVLLEVKAYIQNRVTNFRFSLFTKITTSTYLFLFIVGVLAILLFEHNHAFKGLSWHQSLFYSLFQSATTRSAGLQTIDVTTLSDPTNIIMGILMFIGSSPSSVGGGIRTTTFAILILFLINFSNNADKTSIKVYNREVHIMDIQRSFAVFTMATILTFLGMLIISATENGKLTFLQVFFEVMSAFGTCGLSLGVTSDISDISKVVLMILMFIGRVGLISFIIMIAGRREPDKFHYPKERIQIG

SEQ ID NO: 4823 - DNA, 2322 bp, Staphylococcus aureus
atggagtggacattagtggatattggtaaaaaacatgtaattcctaaaagtcagtaccgacgtaagcgtcgtgaattcttccacaacgaagacagagaagaaaatttaaatcaacatcaagataaacaaaatatagataatacaacatcaaaaaaagcagataagcaaatacataaagattcaattgataagcacgaacgttttaaaaatagtttatcatcgcatttagaacagagaaaccgtgatgttaatgagaataaagctgaagaaagtaaaagtaatcaggatagtaagtcagcatataacagagatcattatttaacagacgatgtatctaaaaaacaaaattcattagattcagtggaccaagatacagagaaatcaaaatattatgagcaaaattctgaagcgactttatcaactaaatcaaccgataaagtagaatcaactgaaatgagaaagctaagttcagataaaaacaaagttggtcatgaagagcaacatgtactttctaaaccttcagaacatgataaagagactagaattgattctgagtcttcaagaactgattcagacagctcgatgcagacagagaaaataaaaaaagacagttcagatggaaataaaagtagtaatctgaaatctgaagtaatatcagacaaatcaaatacagtaccaaaattgtcggaatctgatgatgaagtaaataatcagaagccattaactttaccggaagaacagaaattgaaaagacagcaaagtcaaaatgagcaaacaaaaacctatacatatggtgatagcgaacaaaatgacaagtctaatcatgaaaatgatttaagtcatcatataccatcgataagtgatgataaagataacgtcatgagagaaaatcatattgttgacgataatcctgataatgatatcaatacaccatcattatcaaaaacagatgacgatcgaaaacttgatgaaaaaattcatgttgaagataaacataaacaaaatgcagactcgtctgaaacggtgggatatcaaagtcagtcaactgcatctcatcgtagcactgaaaaaagaaatatttctattaatgaccatgataaattaaacggtcaaaaaacaaatacaaagacatcggcaaataataatcaaaaaaaggctacatcaaaattgaacaaagggcgcgctacgaataataattatagtgacattttgaaaaagttttggatgatgtattggcctaaattagttattctaatgggtattattattctaattgttattttgaatgccatttttaataatgtgaacaaaaatgatcgcatgaatgataataatgatgcagatgctcaaaaatatacgacaacgatgaaaaatgccaataacacagttaaatcggtcgttacagttgaaaatgaaacatcaaaagattcatcattacctaaagataaagcatctcaagacgaagtgggatcaggtgttgtatataaaaaatctggagatacgttatatattgttacgaatgcacacgttgtcggtgataaagaaaatcaaaaaataactttctcgaataataaaagtgttgttgggaaagtgcttggtaaagataaatggtcagatttagctgttgttaaagcaacttcttcagacagttcagtgaaagagatagctattggagattcaaataatttagtgttaggagagccaatattagtcgtaggtaatccacttggtgtagactttaaaggcactgtgacagaaggtattatttcaggtctgaacagaaatgttcctattgatttcgataaagataataaatatgatatgttgatgaaagctttccaaattgatgcatcagtaaatccaggtaactcgggtggtgctgtcgtcaatagagaaggaaaattaataggtgtagttgcagctaaaattagtatgccaaacgttgaaaatatgtcatttgcaatacctgttaatgaagtacaaaagattgtaaaagatttagaaacaaaaggtaaaattgactatcccgatgtaggtgttaaaatgaagaatattgtcagtctaaatagttttgaaagacaagcagttaaattgccaggaaaagttaagaacggtgttgttgtagatcaagttgacaacaatggtttagcagatcaatctggtctgaaaaaaggtgatgtaattactgaattagatggcaaacttttagaagatgatttacgctttaggcagattatatttagtcataaagatgacttgaaatcaattacagcgaagatttatagagatggtaaagagaaagaaattaatattaaactaaaa

SEQ ID NO: 4824 - protein, 774 aa, Staphylococcus aureus
  MISC_FEATURE (1)..(774): serine protease HtrA
MEWTLVDIGKKHVIPKSQYRRKRREFFHNEDREENLNQHQDKQNIDNTTSKKADKQIHKDSIDKHERFKNSLSSHLEQRNRDVNENKAEESKSNQDSKSAYNRDHYLTDDVSKKQNSLDSVDQDTEKSKYYEQNSEATLSTKSTDKVESTEMRKLSSDKNKVGHEEQHVLSKPSEHDKETRIDSESSRTDSDSSMQTEKIKKDSSDGNKSSNLKSEVISDKSNTVPKLSESDDEVNNQKPLTLPEEQKLKRQQSQNEQTKTYTYGDSEQNDKSNHENDLSHHIPSISDDKDNVMRENHIVDDNPDNDINTPSLSKTDDDRKLDEKIHVEDKHKQNADSSETVGYQSQSTASHRSTEKRNISINDHDKLNGQKTNTKTSANNNQKKATSKLNKGRATNNNYSDILKKFWMMYWPKLVILMGIIILIVILNAIFNNVNKNDRMNDNNDADAQKYTTTMKNANNTVKSVVTVENETSKDSSLPKDKASQDEVGSGVVYKKSGDTLYIVTNAHVVGDKENQKITFSNNKSVVGKVLGKDKWSDLAVVKATSSDSSVKEIAIGDSNNLVLGEPILVVGNPLGVDFKGTVTEGIISGLNRNVPIDFDKDNKYDMLMKAFQIDASVNPGNSGGAVVNREGKLIGVVAAKISMPNVENMSFAIPVNEVQKIVKDLETKGKIDYPDVGVKMKNIVSLNSFERQAVKLPGKVKNGVVVDQVDNNGLADQSGLKKGDVITELDGKLLEDDLRFRQIIFSHKDDLKSITAKIYRDGKEKEINIKLK

SEQ ID NO: 4825 - DNA, 3009 bp, Staphylococcus aureus
atggtttatttaaaatcaatagatgccattggatttaagtcttttgcagatcaaaccaatgttcaattcgataaaggtgtaactgcaattgttggtccaaatggaagcggtaaaagtaatattacagatgctattaaatgggtgttgggtgaacaatcggctaaatcattacgtggctcaaaaatggaagatattatcttctcaggtgcagaacatcgcaaagctcaaaattatgctgaagtacagttaagattagataatcattctaaaaagctcagtgttgatgaaaacgaagttattgtaacaagaagattgtatcgaagtggtgaaagtgagtactacataaataatgaccgtgcaagattaaaagatattgccgatttatttttagattctggattgggaaaagaagcgtatagcattatctcgcaaggtagagttgatgaaatactaaatgctaaaccaattgatagacgtcaaattattgaagaatcggctggtgtacttaaatataaaaaacgtaaggctgaatcattaaataaacttgaccaaacagaagataatttaacgagagtagaagacattttatatgatttggaaggtcgcgtagaacctctaaaagaggaggcagctatagctaaagaatataagacactttcacatcaaatgaaacatagtgacattgtagttacagtgcacgatattgatcaatatacaaatgacaatagacaattagatcaacgtttaaatgatttacaaggccaacaagcaaataaagaagctgacaagcaacgtttaagccaacaaattcaacaatataaaggtaaacgtcatcaacttgataatgatgttgaatcgcttaattatcaattagtaaaagctacggaagcctttgaaaaatatacgggacaattaaatgttttggaagaacgtaagaaaaatcaatctgaaacaaatgcacgatatgaagaagaacaagaaaatttaatggagcttttagaaaatatatcaaatgagatttctgaagctcaagatacttataagtctctgaaaagtaaacaaaaagaactcaatgctgtcattcgtgaacttgaagaacaactatatgtttcagacgaagcacatgatgaaaaattggaagaaattaaaaacgaatactatacattaatgtcagagcaatcagatgttaacaatgatattcgttttttaaagcatactatagaagagaatgaggctaaaaaatcaagactagattctcgattagttgaagtttttgagcaattgaaagatattcagggtcaaataaaaacgacaaaaaaagaatatcaacagaccaacaaagaactttctgctgtagataaagaaattaaaaatatagaaaaagacctcactgatacaaaaaaagcacaaaatgaatacgaagagaaattgtatcaagcatatcgatataccgaaaaaatgaaaacacgtattgatagtttggcaacgcaagaggaagaatatacttattttttcaatggcgtcaaacatattttgaaagctaaaaataaagaattaaagggtatttatggtgcagttgcggaaattattgatgtgccatctaaattaactcaggcaattgaaacagcattaggtgcttcattacaacatgtcattgtagattcagaaaaagatggacgccaggctattcaatttttaaaagaacgtaatttaggtcgtgcgacgtttttaccattaaatgttatacagagtagagtggtagcgactgatattaaatctattgctaaagaggcaaacggatttattagtatcgcttcggaagcagttaaagtagcaccagaatatcaaaatattatcgggaatttattaggtaatacgattatcgttgatcatttaaagcatgcaaatgaattggcacgtgcgattaaatatcgaactcgtattgttactttggaaggtgatattgtaaatcctggtggttctatgactggtggtggcgctcgtaagtcaaaaagtattctgtctcaaaaagacgagttgacaacaatgagacaccaattagaagattacttgcgtcaaacagaatcatttgaacaacaatttaaagagttgaagataaaaagtgatcaattaagtgaactgtattttgaaaaaagtcaaaagcataatacacttaaagagcaagtgcatcattttgaaatggagctcgatagattaactacacaagaaacacaaataaaaaatgatcatgaagaattcgaatttgaaaaaaatgatggttatacgagtgacaaaagtcgacaaactttgagtgaaaaagaaacttatctagaaagtattaaagcatctttaaaacgactagaagatgaaattgaacgctacacaaaactttctaaagaaggtaaggaaagcgttactaaaacacaacaaaccttacatcagaaacaatctgatcttgctgtggttaaagagcgtattaaaacacaacaacagacaatagatcgattaaataatcaaaatcaacaaactaaacatcaattaaaagatgttaaagaaaaaattgcattctttaattcggatgaagtgatgggcgaacaagcttttcaaaatattaaagatcaaattaatggtcaacaagaaacgagaacacgcttatcagatgaattagataaattgaaacaacaacgtattgagttgaatgaacaaatcgatgcgcaagaagctaaactacaagtttgtcaccaagatattttagctatcgaaaatcactaccaagatattaaagctgaacaatcaaagctagatgtattaattcatcatgcgatagatcatttaaatgatgaatatcaattgactgttgaacgtgcgaaatctgaatatacgagtgatgaatcgattgacgcattacgtaaaaaagttaagttaatgaagatgtcgattgatgaactaggtcctgtaaacttaaatgcaattgaacaatttgaagagttaaatgaacgttatactttt

SEQ ID NO: 4826 - protein, 1003 aa, Staphylococcus aureus
  MISC_FEATURE (1)..(1003): chromosome segregation SMC
MVYLKSIDAIGFKSFADQTNVQFDKGVTAIVGPNGSGKSNITDAIKWVLGEQSAKSLRGSKMEDIIFSGAEHRKAQNYAEVQLRLDNHSKKLSVDENEVIVTRRLYRSGESEYYINNDRARLKDIADLFLDSGLGKEAYSIISQGRVDEILNAKPIDRRQIIEESAGVLKYKKRKAESLNKLDQTEDNLTRVEDILYDLEGRVEPLKEEAAIAKEYKTLSHQMKHSDIVVTVHDIDQYTNDNRQLDQRLNDLQGQQANKEADKQRLSQQIQQYKGKRHQLDNDVESLNYQLVKATEAFEKYTGQLNVLEERKKNQSETNARYEEEQENLMELLENISNEISEAQDTYKSLKSKQKELNAVIRELEEQLYVSDEAHDEKLEEIKNEYYTLMSEQSDVNNDIRFLKHTIEENEAKKSRLDSRLVEVFEQLKDIQGQIKTTKKEYQQTNKELSAVDKEIKNIEKDLTDTKKAQNEYEEKLYQAYRYTEKMKTRIDSLATQEEEYTYFFNGVKHILKAKNKELKGIYGAVAEIIDVPSKLTQAIETALGASLQHVIVDSEKDGRQAIQFLKERNLGRATFLPLNVIQSRVVATDIKSIAKEANGFISIASEAVKVAPEYQNIIGNLLGNTIIVDHLKHANELARAIKYRTRIVTLEGDIVNPGGSMTGGGARKSKSILSQKDELTTMRHQLEDYLRQTESFEQQFKELKIKSDQLSELYFEKSQKHNTLKEQVHHFEMELDRLTTQETQIKNDHEEFEFEKNDGYTSDKSRQTLSEKETYLESIKASLKRLEDEIERYTKLSKEGKESVTKTQQTLHQKQSDLAVVKERIKTQQQTIDRLNNQNQQTKHQLKDVKEKIAFFNSDEVMGEQAFQNIKDQINGQQETRTRLSDELDKLKQQRIELNEQIDAQEAKLQVCHQDILAIENHYQDIKAEQSKLDVLIHHAIDHLNDEYQLTVERAKSEYTSDESIDALRKKVKLMKMSIDELGPVNLNAIEQFEELNERYTF

SEQ ID NO: 4827 - DNA, 807 bp, Staphylococcus aureus
ttgtacatgttaatggatccaagtttgatcttaccttatttatgggtacttgtcgttttagtatttttagaaggcttattagcagcagataacgcgattgttatggctgtaatggttaagcacttaccacccgaacaacgtaaaaaagctttgttttacggtttgttaggtgcatttgtatttagatttttagcattattcttaattagtattatcgcgaacttttggtttattcaagctgcaggagcggtttacttaatttatatgtcaatcaaaaatctgtggcagttctttaaacacccagaaattgaaagtcctgaagctggagatgatcatcattatgatgaatctggtgaagagattaaagcaagtaacaaatcattctggggaactgtgttgaaaatagaatttgcagatatcgcatttgccattgattctatgcttgctgctttagctattgctgtaacacttcctaaagttggtattcactttggtggtatggacttaggtcagttcgtagtcatgttcctaggtggaatgattggtgttattctaatgcgttatgcagcaacatggtttgtagagctattaaacaaatatccaggacttgaaggtgcagccttcgcgatcgttggttgggtaggtgttaaattagttgtcatggtattagcgcacccagacatcgctgtattgcctgagcacttcccacatggcgtattatggcaatctattttctggacagtactaattggattagtaattatcggttggttaggttcagttgttaaaaataaaaaatcgcataaa

SEQ ID NO: 4828 - protein, 269 aa, Staphylococcus aureus
  MISC_FEATURE (1)..(269): toxic anion resistance
LYMLMDPSLILPYLWVLVVLVFLEGLLAADNAIVMAVMVKHLPPEQRKKALFYGLLGAFVFRFLALFLISIIANFWFIQAAGAVYLIYMSIKNLWQFFKHPEIESPEAGDDHHYDESGEEIKASNKSFWGTVLKIEFADIAFAIDSMLAALAIAVTLPKVGIHFGGMDLGQFVVMFLGGMIGVILMRYAATWFVELLNKYPGLEGAAFAIVGWVGVKLVVMVLAHPDIAVLPEHFPHGVLWQSIFWTVLIGLVIIGWLGSVVKNKKSHK

SEQ ID NO: 4829 - DNA, 1560 bp, Staphylococcus aureus
atgaacttaaagcaagaagttgagtctagaaagacttttgcgattatttcacatcccgatgcagggaaaacaacgttaactgaaaaactattgtacttcagtggtgctattcgtgaagcgggtacagttaaagggaagaagactggtaaatttgcgacaagtgactggatgaaagttgaacaagagcgtggtatttctgtaactagttcagtaatgcaatttgattacgatgattataaaatcaatatcttagatacaccaggacatgaagacttttcagaagatacgtatagaacattaatggcagttgacagtgctgtcatggtcatagactgtgcaaaaggtattgaaccacaaacattgaagttatttaaagtttgtaaaatgcgtggtattccaatctttacattcattaataaattagaccgagtaggtaaagaaccatttgaattattagatgaaatcgaagagacattaaatattgaaacataccctatgaattggccaattggtatgggacaaagtttctttggcatcattgatagaaagtctaaaacaattgaaccatttagagatgaagaaaatatattacatttgaatgatgattttgagttggaagaagatcatgcaattacaaatgatagtgattttgaacaagcgattgaagaattaatgttggttgaagaagcgggtgaagcctttgataatgacgcgctgttgagtggagacttaacacctgtatttttcggttcagctttagctaactttggtgtacaaaatttcttaaatgcatatgttgattttgcgccaatgccaaatgcgagacaaacaaaagaagacgttgaagtaagcccgtttgatgattcattttcaggatttatctttaaaattcaagccaacatggaccctaaacaccgtgatagaattgcctttatgcgtgtcgttagtggtgcatttgaacgtggtatggatgttactttgcaacgtactaataaaaagcaaaagatcacacgttcaacgtcatttatggcagacgataaagaaactgtgaatcatgctgtagcaggcgatatcattggactatatgatactggtaattatcaaattggagatactttagttggtggaaaacaaacctacagtttccaagatttaccacaatttacgccagaaatttttatgaaagtttctgctaaaaacgtcatgaaacagaagcatttccataaaggtattgaacaattagtacaagaaggtgcgattcaatactataaaacattacacacaaaccaaattattttaggtgctgttggtcagttacaatttgaagttttcgaacatagaatgaaaaacgaatataatgttgatgttgttatggagccagtaggccgtaaaattgcacgttggattgaaaatgaagaccaaattacagataagatgaacacatcaagatcgattttagtgaaagatagatatgacgatttagtattcttatttgaaaatgaatttgcaacaagatggtttgaagagaaattccctgaaattaaattgtatagtttactt

SEQ ID NO: 4830 - protein, 520 aa, Staphylococcus aureus
  MISC_FEATURE (1)..(520): peptide chain release
MNLKQEVESRKTFAIISHPDAGKTTLTEKLLYFSGAIREAGTVKGKKTGKFATSDWMKVEQERGISVTSSVMQFDYDDYKINILDTPGHEDFSEDTYRTLMAVDSAVMVIDCAKGIEPQTLKLFKVCKMRGIPIFTFINKLDRVGKEPFELLDEIEETLNIETYPMNWPIGMGQSFFGIIDRKSKTIEPFRDEENILHLNDDFELEEDHAITNDSDFEQAIEELMLVEEAGEAFDNDALLSGDLTPVFFGSALANFGVQNFLNAYVDFAPMPNARQTKEDVEVSPFDDSFSGFIFKIQANMDPKHRDRIAFMRVVSGAFERGMDVTLQRTNKKQKITRSTSFMADDKETVNHAVAGDIIGLYDTGNYQIGDTLVGGKQTYSFQDLPQFTPEIFMKVSAKNVMKQKHFHKGIEQLVQEGAIQYYKTLHTNQIILGAVGQLQFEVFEHRMKNEYNVDVVMEPVGRKIARWIENEDQITDKMNTSRSILVKDRYDDLVFLFENEFATRWFEEKFPEIKLYSLL

SEQ ID NO: 4831 - DNA, 261 bp, Staphylococcus aureus
gtggtggccctgttgattaataaaagatttattgatgaaggtaaaactattgatgtttatttattcgaagcattaaataaccagataatcattgctataccagattggttttggtcatatcagatggcaatgacattagatgaagaaacttgttttgaagcaatactcatgcaattgtttgtttttaaagaagaggaagaggcagaatcgattgcatcacaactaacagattggatagaaacatataaaaaggagaaagac

SEQ ID NO: 4832 - protein, 87 aa, Staphylococcus aureus
  MISC_FEATURE (1)..(87): hypothetical protein
VVALLINKRFIDEGKTIDVYLFEALNNQIIIAIPDWFWSYQMAMTLDEETCFEAILMQLFVFKEEEEAESIASQLTDWIETYKKEKD

SEQ ID NO: 4833 - DNA, 1479 bp, Staphylococcus aureus
ttggatgcaagtacgttgtttaagaaagtaaaagtaaagcgtgtattgggttctttagaacaacaaatagatgatatcactactgattcacgtacagcgagagaaggtagcatttttgtcgcttcagttggatatactgtagacagtcataagttctgtcaaaatgtagctgatcaagggtgtaagttggtagtggtcaataaagaacaatcattaccagctaacgtaacacaagtggttgtgccggacacattaagagtagctagtattctagcacacacattatatgattatccgagtcatcagttagtgacatttggtgtaacgggtacaaatggtaaaacttctattgcgacgatgattcatttaattcaaagaaagttacaaaaaaatagtgcatatttaggaactaatggtttccaaattaatgaaacaaagacaaaaggtgcaaatacgacaccagaaacagtttctttaactaagaaaattaaagaagcagttgatgcaggcgctgaatctatgacattagaagtatcaagccatggcttagtattaggacgactgcgaggcgttgaatttgacgttgcaatattttcaaatttaacacaagaccatttagattttcatggcacaatggaagcatacggacacgcgaagtctttattgtttagtcaattaggtgaagatttgtcgaaagaaaagtatgtcgtgttaaacaatgacgattcattttctgagtatttaagaacagtgacgccttatgaagtatttagttatggaattgatgaggaagcccaatttatggctaaaaatattcaagaatctttacaaggtgtcagctttgattttgtaacgccttttggaacttacccagtaaaatcgccttatgttggtaagtttaatatttctaatattatggcggcaatgattgcggtgtggagtaaaggtacatctttagaaacgattattaaagctgttgaaaatttagaacctgttgaagggcgattagaagttttagatccttcgttacctattgatttaattatcgattatgcacatacagctgatggtatgaacaaattaatcgatgcagtacagccttttgtaaagcaaaagttgatatttttagttggtatggcaggcgaacgtgatttaactaaaacgcctgaaatggggcgagttgcctgtcgtgcagattatgtcattttcacaccggataatccggcaaatgatgacccgaaaatgttaacggcagaattagccaaaggtgcaacacatcaaaactatattgaatttgatgatcgtgcagaagggataaaacatgcaattgacatagctgagcctggggatactgtcgttttagcatcaaaaggaagagaaccatatcaaatcatgccagggcatattaaggtgccacatcgagatgatttaattggccttgaagcagcttacaaaaagttcggtggtggccctgttgat

SEQ ID NO: 4834 - protein, 493 aa, Staphylococcus aureus
LDASTLFKKVKVKRVLGSLEQQIDDITTDSRTAREGSIFVASVGYTVDSHKFCQNVADQGCKLVVVNKEQSLPANVTQVVVPDTLRVASILAHTLYDYPSHQLVTFGVTGTNGKTSIATMIHLIQRKLQKNSAYLGTNGFQINETKTKGANTTPETVSLTKKIKEAVDAGAESMTLEVSSHGLVLGRLRGVEFDVAIFSNLTQDHLDFHGTMEAYGHAKSLLFSQLGEDLSKEKYVVLNNDDSFSEYLRTVTPYEVFSYGIDEEAQFMAKNIQESLQGVSFDFVTPFGTYPVKSPYVGKFNISNIMAAMIAVWSKGTSLETIIKAVENLEPVEGRLEVLDPSLPIDLIIDYAHTADGMNKLIDAVQPFVKQKLIFLVGMAGERDLTKTPEMGRVACRADYVIFTPDNPANDDPKMLTAELAKGATHQNYIEFDDRAEGIKHAIDIAEPGDTVVLASKGREPYQIMPGHIKVPHRDDLIGLEAAYKKFGGGPVD

SEQ ID NO: 4835 - DNA, 1173 bp, Staphylococcus aureus
atggttactcaaaataaaaagatattgattattactggctcattcggtaacggtcatatgcaagttacacagagtatcgttaatcaacttaatgatatgaatctagaccatttaagcgtcattgagcacgatttatttatggaagctcatccaattttgacttctatttgtaaaaaatggtatatcaatagctttaaatattttagaaatatgtacaaagggttttattacagccgcccagataaactagacaaatgtttttacaaatactatggacttaataagttaattaatttattgataaaagaaaagccagatttaatattattaacgtttcctacaccagttatgtcggtactaactgagcaatttaacattaatattccagttgctacagtgatgacagactatcgcttacataaaaactggattacgccgtattcaacaagatattatgtggcaacaaaagaaacgaaacaagacttcatagacgtaggtattgatccttcaacagttaaagtgacaggtattcctattgataacaaatttgaaacgcctattaatcaaaagcagtggttaatagacaacaacttagatccagataagcaaactattttaatgtcagctggtgcatttggtgtatctaaaggttttgacacgatgattactgatatattagcgaaaagtgcaaatgcacaagtagttatgatttgtggtaagagcaaagagctaaagcgttctttaacagctaagtttaaatctaacgagaatgtattgattctaggttataccaaacacatgaatgaatggatggcatcaagtcaacttatgattacgaaacctggtggtatcacaataactgaaggtttcgcccgttgtattccaatgattttcctaaatcctgcacctggtcaagagcttgaaaatgccctttactttgaagaaaaaggttttggtaaaatcgctgatactccagaagaagcaataaaaattgtagcaagtttaactaacggtaatgagcaattaactaacatgattagtacaatggaacaagataaaattaagtatgctacacagacaatatgtcgagacttacttgatttaatcggtcattcatcacaaccacaagagatttatggaaaggttcctttatatgcaagattcttcgttaaa

SEQ ID NO: 4836 - protein, 391 aa, Staphylococcus aureus
  MISC_FEATURE (1)..(391): hypothetical protein
MVTQNKKILIITGSFGNGHMQVTQSIVNQLNDMNLDHLSVIEHDLFMEAHPILTSICKKWYINSFKYFRNMYKGFYYSRPDKLDKCFYKYYGLNKLINLLIKEKPDLILLTFPTPVMSVLTEQFNINIPVATVMTDYRLHKNWITPYSTRYYVATKETKQDFIDVGIDPSTVKVTGIPIDNKFETPINQKQWLIDNNLDPDKQTILMSAGAFGVSKGFDTMITDILAKSANAQVVMICGKSKELKRSLTAKFKSNENVLILGYTKHMNEWMASSQLMITKPGGITITEGFARCIPMIFLNPAPGQELENALYFEEKGFGKIADTPEEAIKIVASLTNGNEQLTNMISTMEQDKIKYATQTICRDLLDLIGHSSQPQEIYGKVPLYARFFVK

SEQ ID NO: 4837 - DNA, 1098 bp, Staphylococcus aureus
atgtatatcctaagctatattaatttcttgccaacagttacatccattgctgtagcaataacgtctctagcattttcaatacattttattgctgatgcatctacaaactttgttataggatttttactgaaaaaattcggcacaaaaatcgttttaacgactggatttattttagcatttacaagtttatttttagttatttggtttccagcatcaccttttgtaatcatatttagtgctatgatgctcggtattgcagttagtcctatttgggtcattatgttatccagtgttgaagaagataaacgtggcaaacaaatgggctatgtttatttttcatggttgttaggcctattggtaggtatggtttttatgaatctacttatcaaagtgcacccaacacgctttgccttcatgatgtctttagtcgttttaattgcatggatattatattattttgtcgatgtaaagttaacaaattataatactcgtccagttaaagctcaattgagacaaattgttgatgtgacaaagcgccatttattgttgttccctggtattcttttacaaggtgccgcaattgctgccctagttcctatattaccaacatatgctactaaggttattaacgtaagcacaattgaatatactgttgcaatcattattggtggtatcggctgtgcagtttcgatgctatttttatcgaaactaatagataaccgcagcagaaactttatgtatggtgttattctaagcggatttattttatacatgatattaatttttactctatctatgattgttaatattcacatcttgtggattatcgctttagctatcggtctaatgtatggcatcttattaccagcatggaatacctttatggcacgatttatcaaatcagatgaacaagaagaaacttggggtgtttttaatagtatccaaggattcggctcaatgatagggccattatttggcggattaattacacaatttaccaacaatttaaacaatacattttatttctcggcattaatctttttagtcttagctgtattttatggaagctactttatagtaaatagagaaaaagctaag

SEQ ID NO: 4838 - protein, 366 aa, Staphylococcus aureus
  MISC_FEATURE (1)..(366): hypothetical protein
MYILSYINFLPTVTSIAVAITSLAFSIHFIADASTNFVIGFLLKKFGTKIVLTTGFILAFTSLFLVIWFPASPFVIIFSAMMLGIAVSPIWVIMLSSVEEDKRGKQMGYVYFSWLLGLLVGMVFMNLLIKVHPTRFAFMMSLVVLIAWILYYFVDVKLTNYNTRPVKAQLRQIVDVTKRHLLLFPGILLQGAAIAALVPILPTYATKVINVSTIEYTVAIIIGGIGCAVSMLFLSKLIDNRSRNFMYGVILSGFILYMILIFTLSMIVNIHILWIIALAIGLMYGILLPAWNTFMARFIKSDEQEETWGVFNSIQGFGSMIGPLFGGLITQFTNNLNNTFYFSALIFLVLAVFYGSYFIVNREKAK

SEQ ID NO: 4839 - DNA, 507 bp, Staphylococcus aureus
atgattttaggattagcattaattccatcaaagtcatttcaagaagcggtggattcttaccgtaaaagatatgataaacagtattcacgaattaaaccacatgtgacaattaaagcgccatttgaaattaaagatggtgatttagattctgtcattgaacaggttagagctcgtattaatggtataccagcagtagaagttcatgctacaaaagcttctagcttcaaaccaacgaacaatgtgatttactttaaagttgcgaagacggacgacttagaagaattgtttaatcgctttaatggagaagatttctatggagaagctgaacatgtttttgtgccacactttacaatagcacaaggactatctagccaagaattcgaagatatttttggtcaagtagcattagctggggtagaccataaagaaattatcgatgaattaactttgttacgttttgacgatgacgaagataaatggaaagttattgaaacgtttaaattagct

SEQ ID NO: 4840 - protein, 169 aa, Staphylococcus aureus
  MISC_FEATURE (1)..(169): conserved hypothetical
MILGLALIPSKSFQEAVDSYRKRYDKQYSRIKPHVTIKAPFEIKDGDLDSVIEQVRARINGIPAVEVHATKASSFKPTNNVIYFKVAKTDDLEELFNRFNGEDFYGEAEHVFVPHFTIAQGLSSQEFEDIFGQVALAGVDHKEIIDELTLLRFDDDEDKWKVIETFKLA

SEQ ID NO: 4841 - DNA, 756 bp, Staphylococcus aureus
atgtcagaatttaaaactggtaagattaataaacatgttttatatagtaatattttaaatagagatgtcacgttaagtatttatttaccagaatcttataatcaacttgttaaatataatgtcattctttgctttgacggattagattttttacgtttcgggagaatacaacgtacatatgaatcgttaatcaaagaagcgcgtattgatgatgcgatcattgttggattccattatgaagacgttgataagcgtagagaggaatttcatccacaaggaagtcgttctcatttaactattcaatcagtcggtaaagaaatattgccatttattgactcgacgttttctacactgaaagtaggtaatgcaaggttattagtaggggatagtttagcgggtagtattgccttattaacggcgttgacctatccaacgatttttagtcgtgtagcaatgttaagtccacattcagatgaaaaagtattagataagctaaatcaatgtgcaaataaagaacaattgacaatttggcatgtcattggtctagatgaaaaagattttactttaccaacaaatggtaagcgtgccgatttcttaacaccgaatagagaattagctgaacaaattaagaaatataatataacttattattacgatgaatttgatggtggtcaccaatggaaagattggaaaccattgctgtcagatatattattgtattttttaagtaaaaacacagatgatcaactttatgaa

SEQ ID NO: 4842 - protein, 252 aa, Staphylococcus aureus
  MISC_FEATURE (1)..(252): conserved hypothetical
MSEFKTGKINKHVLYSNILNRDVTLSIYLPESYNQLVKYNVILCFDGLDFLRFGRIQRTYESLIKEARIDDAIIVGFHYEDVDKRREEFHPQGSRSHLTIQSVGKEILPFIDSTFSTLKVGNARLLVGDSLAGSIALLTALTYPTIFSRVAMLSPHSDEKVLDKLNQCANKEQLTIWHVIGLDEKDFTLPTNGKRADFLTPNRELAEQIKKYNITYYYDEFDGGHQWKDWKPLLSDILLYFLSKNTDDQLYE

SEQ ID NO: 4843 - DNA, 1626 bp, Staphylococcus aureus
ttgaagtgtctcgtgcttaatcgtataatatttttatgtttaaacaatagggggaatcttatgattgaaaaattagtaacctttttaaatgaggttgtttggagtaagccattagtttatggtttgctaattactggtgtgctatttacattgcgtatgcgattttttcaagttagacattttaaagaaatgattcgattaatgtttcaaggagagaagtctcctaatggtatttcaagttttcaagcgatagccatgtctttagcaggcagggttggtacaggtaatattgtcggtgtatctactgcaatatttataggaggacctggtgcagtattttggatgtggattactgcgtttttaggtgcaagtagtgcttttattgaatctacacttggtcaaatattcaagagagttgaaaataatgaataccgtggtggaccagcgtattatattgaatatggtattggtggtaaatttggtaaaatttacggaattatctttgctattgttacgattatctcagtaggtctattgcttcctggtgtgcaatctaacgctatagcaagttctatgcataatgcgattcatgttccacaatggttaatgggtggtattgttgtagttattttgggattaattatttttggtggtgtacgtattattgccaatgttgcaacagccgttgtaccatttatggcaattatttacatactgatggctgtcattatcatttgtatcaatatacaagaagtgccagcgttatttgcattaattttcaaatcagcatttggattacaatctgcttttggtggtatcgttggcgcaatgatagagattggtgttaaacgtggattatattcaaatgaggctggtcaaggtacaggtccacacgcagcagcggcagcagaagtatcacatccaagtaaacaaggtctagtacaagcattttcagtttatattgatacattatttgtatgtactgcaactgctctgattatacttatttctggtacatataatgtgactgatggtacggttaatgcgaatggcacaccgcatttaattaaagatggcggtatttatgttgaaaatgcaacaggtaaagattattcaggtactgcgatgtatgcacaagccggcattgataaagcgttccatggcagtggttatcaatttgatcctactttctctggcgtaggttcgtactttattgcatttgctttattcttctttgcatttactacaattttgtcgtactactacattacagaaacaaatgttgcttatttaacgcgtaatcaaaataatcaagtttcatcgatatttattaatattgctcgtgtgattattttgttcgctacattttacggtgcagttaaaacagctgatgtagcatgggcattcggtgatttaggtgtaggtctaatggcttggttaaatatcattgcgatttggattttacataagcctgccgtaaatgctttaaaagattatgaaattcaaaagaaacgtttaggcaacggttataatgcagtttatcaacctgatccgaataaattacctaatgctgtcttttggttgaagacgtatccagaacgtttaaaacaagcacgtgccaaaaag

SEQ ID NO: 4844 - protein, 542 aa, Staphylococcus aureus
  MISC_FEATURE (1)..(542): hypothetical protein
LKCLVLNRIIFLCLNNRGNLMIEKLVTFLNEVVWSKPLVYGLLITGVLFTLRMRFFQVRHFKEMIRLMFQGEKSPNGISSFQAIAMSLAGRVGTGNIVGVSTAIFIGGPGAVFWMWITAFLGASSAFIESTLGQIFKRVENNEYRGGPAYYIEYGIGGKFGKIYGIIFAIVTIISVGLLLPGVQSNAIASSMHNAIHVPQWLMGGIVVVILGLIIFGGVRIIANVATAVVPFMAIIYILMAVIIICINIQEVPALFALIFKSAFGLQSAFGGIVGAMIEIGVKRGLYSNEAGQGTGPHAAAAAEVSHPSKQGLVQAFSVYIDTLFVCTATALIILISGTYNVTDGTVNANGTPHLIKDGGIYVENATGKDYSGTAMYAQAGIDKAFHGSGYQFDPTFSGVGSYFIAFALFFFAFTTILSYYYITETNVAYLTRNQNNQVSSIFINIARVIILFATFYGAVKTADVAWAFGDLGVGLMAWLNIIAIWILHKPAVNALKDYEIQKKRLGNGYNAVYQPDPNKLPNAVFWLKTYPERLKQARAKK

SEQ ID NO: 4845 - DNA, 1083 bp, Staphylococcus aureus
atgttaaacaaggtttggttccgaactggcatcgctctgattatgctgttcattctcatcaaactatttatggaagtgcacgaagtatttactccaatagctacaatcatcggttctgtatttcttccatttttaattagtggttttttattttatatctgtctaccttttcaaaacttacttgaaaaagtcggttttccaagatgggctagtataacaacaatcatgttagctttgtttgctattatcggcttaattgttgcgtttgttgcaccaatcatcatttcaaatatcaacaatttaattagtcagacacctgccctacaaaaagaagcagagcaaattattaaattcgcactagctcaaatggataaattacctgaagatgtaacaagtagaattacaaatatggttaaatcaatgggtgatggcgttactaatattttatctaattcattacagtacattacatcattaatttcaaccatcttcttattgattatggttccattcttcttaatttatatgttaaaagaccatgaaaaatttatcccagctgttgctaaatttttcaaaggtgaacgtaaagtatttttcgtagatttattaactgatttaaactttacattaaaatcttacattcaaggtcaagtaactgtcagtgttattttaggtatattcttatatatcggttattcaattattgacttaccatatattcctttattagtactatttgctggtgtcgcaaacttaattcctttcttaggttcatggttatcatttgcacctgcagcaatactcggtattatagatagtcctactacatttatatgggtttgtatcattacattaattgcacatcaacttgaaggtaatatcattacaccaaatgtaatgggtaaatctttaagtatccatcctttaacaattatcgttgttattttagcagcaggagatttaggtggctttacattagttctgattgcagtgccattatatgctgtacttaaaacggttgttagtaatattttcaaataccgccaacgcattattgataaagcaaacagtaatgttaaggac

SEQ ID NO: 4846 - protein, 361 aa, Staphylococcus aureus
  MISC_FEATURE (1)..(361): conserved hypothetical
MLNKVWFRTGIALIMLFILIKLFMEVHEVFTPIATIIGSVFLPFLISGFLFYICLPFQNLLEKVGFPRWASITTIMLALFAIIGLIVAFVAPIIISNINNLISQTPALQKEAEQIIKFALAQMDKLPEDVTSRITNMVKSMGDGVTNILSNSLQYITSLISTIFLLIMVPFFLIYMLKDHEKFIPAVAKFFKGERKVFFVDLLTDLNFTLKSYIQGQVTVSVILGIFLYIGYSIIDLPYIPLLVLFAGVANLIPFLGSWLSFAPAAILGIIDSPTTFIWVCIITLIAHQLEGNIITPNVMGKSLSIHPLTIIVVILAAGDLGGFTLVLIAVPLYAVLKTVVSNIFKYRQRIIDKANSNVKD

SEQ ID NO: 4847 - DNA, 729 bp, Staphylococcus aureus
atgtctaaacaaaagaaaagtgagatagttaatcgttttagaaagcgctttgatactaaaatgacagagttaggctttacttatcaaaatattgatttataccaacaagcattttcgcattcgagttttattaatgattttaatatgaatcgtttagaccataatgagcgtttagagtttttgggtgatgcggtattagaattgacggtttcacgatatttatttgataaacatcccaacttgccagaagggaatttaacaaaaatgcgtgccactattgtatgtgagccctcacttgtaatatttgcgaataaaattggattgaacgaaatgattttacttggtaaaggtgaagagaaaacagggggacgtacaagaccatcattaatatcagatgcattcgaagcatttattggggcattgtatttggatcaaggactagatatagtttggaaatttgctgagaaagtcattttcccacatgtagaacaaaatgagttattaggcgtggtagattttaaaacacaattccaagaatatgtgcaccagcaaaataaaggtgatgtaacctataatttaataaaagaagagggaccggcacatcatcgtctattcacttcagaagttattctgcaaggggaagcaatagctgaaggtaaagggaaaacgaaaaaagaatcagaacaacgtgctgctgaaagtgcctataagcaattaaaacaaattaaa

SEQ ID NO: 4848 - protein, 243 aa, Staphylococcus aureus
  MISC_FEATURE (1)..(243): RNase III [Staphylococcus
MSKQKKSEIVNRFRKRFDTKMTELGFTYQNIDLYQQAFSHSSFINDFNMNRLDHNERLEFLGDAVLELTVSRYLFDKHPNLPEGNLTKMRATIVCEPSLVIFANKIGLNEMILLGKGEEKTGGRTRPSLISDAFEAFIGALYLDQGLDIVWKFAEKVIFPHVEQNELLGVVDFKTQFQEYVHQQNKGDVTYNLIKEEGPAHHRLFTSEVILQGEAIAEGKGKTKKESEQRAAESAYKQLKQIK

SEQ ID NO: 4849 - DNA, 768 bp, Staphylococcus aureus
atgttaaatcttgaaaacaaaacatatgtcatcatgggaatcgctaataagcgtagtattgcttttggtgtcgctaaagttttagatcaattaggtgctaaattagtatttacttaccgtaaagaacgtagccgtaaagagcttgaaaaattattagaacaattaaatcaaccagaagcgcacttatatcaaattgatgttcaaagcgatgaagaggttattaatggttttgagcaaattggtaaagatgttggcaatattgatggtgtatatcattcaatcgcatttgctaatatggaagacttacgcggacgcttttctgaaacttcacgtgaaggcttcttgttagctcaagacattagttcttactcattaacaattgtggctcatgaagctaaaaaattaatgccagaaggtggtagcattgttgcaacaacatatttaggtggcgaattcgcagttcaaaactataatgtgatgggtgttgctaaagcgagcttagaagcaaatgttaaatatttagcattagacttaggtccagataatattcgcgttaatgcaatttcagctagtccaatccgtacattaagtgcaaaaggtgtgggtggtttcaatacaattcttaaagaaatcgaagagcgtgcacctttaaaacgtaatgttgatcaagtagaagtaggtaaaactgcggcttacttattaagtgatttatcaagtggcgttacaggtgaaaatattcatgtagatagcggattccacgcaattaaa

SEQ ID NO: 4850 - protein, 256 aa, Staphylococcus aureus
  MISC_FEATURE (1)..(256): trans-2-enoyl-ACP reductase
MLNLENKTYVIMGIANKRSIAFGVAKVLDQLGAKLVFTYRKERSRKELEKLLEQLNQPEAHLYQIDVQSDEEVINGFEQIGKDVGNIDGVYHSIAFANMEDLRGRFSETSREGFLLAQDISSYSLTIVAHEAKKLMPEGGSIVATTYLGGEFAVQNYNVMGVAKASLEANVKYLALDLGPDNIRVNAISASPIRTLSAKGVGGFNTILKEIEERAPLKRNVDQVEVGKTAAYLLSDLSSGVTGENIHVDSGFHAIK

SEQ ID NO: 4851 - DNA, 1842 bp, Staphylococcus aureus
atggagtttttatctttagttattgttgttttagcagcgtttttaactccaataattgtcaatcgattaaatattaatttcttgccagttgttgttgcagaaattttgatggggattgtgattggaaattcatttctaaatatagtagaaagggattcaattctaaatattttatcaacgttaggctttatctttttaatgtttttaagtggtttagaaattgattttaaagcttttaaaaaagataaacgcgcacgtcaaggacaaaatgatgatgaatcctcaattccagggcatcttaatctagcgttaactgtatttgcatttattatgattatttcgattcttttagcgtatgtatttaaatggcttggattagtggatgatgtgttattaatggtcattatcatttcaactatttccttaggcgtagttgttccaactttaaaagaaatgaatattatgagaacaactatagggcaatttatcctattagtagcagtacttgcggacttagtaactatgattttattaacggtctatggcgcaatcaatggtcaaggcggcagtacaatatggttaataggtatattagttgttttcacagcaatttcatatattttaggtgttcaatttaaaagaatgtcatttttacaaaaattgatggatggtacgacgcaaatcggtattcgtgcggtatttgcattaataatattattagtagccctagcagagggagttggcgcagaaaatatattaggtgcattcttagcaggtgtcgttgtttcattattaaatccagatgaagaaatggttgaaaagttagactcatttggttatgggttctttattcctattttctttataatggttggtgtagatttaaacataccttcattaattaaagaaccgaaattactaattatcataccgattttaatcgttgcatttatcatttcaaaattaattccagtcatgtttattcgacgttggtttgatatgaaaacaacgattgcatcagcatttttattaacatcaacattatcgctcgtgatagctgcagccaaaatttcagaaagattaaatgctatttcagctgaaacgtcaggtatattaattttaagcgcagtcattacatgtgtattcgttccgattattttcaaaaaactgtttccagttccagatgagtttaaccgtaaaattgaagttagtttaattggtaaaaatcaattaacgattcctatagcgcaaaatttaacatctcagttatatgacgtgacattatattatcgcaaagacttgagtgatcgtcgtcaattgtcagatgatatcacgatgatagaaattgctgattatgaacaagatgttttagaacgactaggtctgtttgaccgagacatagttgtttgtgctacgaatgacgatgatattaaccgaaaagttgctaaattagccaaagcacatcaagttgagcgtgtcatttgcagacttgaaagcacaacggacgatacagagttagttgattcaggtattgaaattttcagtagctacttaagtaataaaatcttattaaaaggtttaattgaaacacctaacatgttgaatttattaagtaatgttgaaacgtcactatatgaaattcaaatgttaaattataaatatgaaaatattcaattacgtaatttcccattcggaggagacatcatcttcgtgcgtattatccgtaataatgagtcgattgttccgcatggagatacacaattgcgatatggagatcgcttaattgttaccggtgctaaagaatacgttgatgaattgaagcaagagttagaattttatttt

SEQ ID NO: 4852 - protein, 614 aa, Staphylococcus aureus
  MISC_FEATURE (1)..(614): Na+/H+ antiporter homologue
MEFLSLVIVVLAAFLTPIIVNRLNINFLPVVVAEILMGIVIGNSFLNIVERDSILNILSTLGFIFLMFLSGLEIDFKAFKKDKRARQGQNDDESSIPGHLNLALTVFAFIMIISILLAYVFKWLGLVDDVLLMVIIISTISLGVVVPTLKEMNIMRTTIGQFILLVAVLADLVTMILLTVYGAINGQGGSTIWLIGILVVFTAISYILGVQFKRMSFLQKLMDGTTQIGIRAVFALIILLVALAEGVGAENILGAFLAGVVVSLLNPDEEMVEKLDSFGYGFFIPIFFIMVGVDLNIPSLIKEPKLLIIIPILIVAFIISKLIPVMFIRRWFDMKTTIASAFLLTSTLSLVIAAAKISERLNAISAETSGILILSAVITCVFVPIIFKKLFPVPDEFNRKIEVSLIGKNQLTIPIAQNLTSQLYDVTLYYRKDLSDRRQLSDDITMIEIADYEQDVLERLGLFDRDIVVCATNDDDINRKVAKLAKAHQVERVICRLESTTDDTELVDSGIEIFSSYLSNKILLKGLIETPNMLNLLSNVETSLYEIQMLNYKYENIQLRNFPFGGDIIFVRIIRNNESIVPHGDTQLRYGDRLIVTGAKEYVDELKQELEFYF

SEQ ID NO: 4853 - DNA, 1383 bp, Staphylococcus aureus
atgtcaatgaacacagatgaaaaagagcgtgttcaagaggaattatacgaccaaactttattagatcaatatttagaaaatgatgatattgatcaatttagagatgaatttctagcattacacacatatgaacaaagtgagtattttgaagatactaccgatgaaaatagacaaaagatttttcaatatttatcacctgaagaagttgcaaatttctttgatcaattagatattgatgacgatgaatatgagttgctatttgataagatgaatgcgacatacgcaagtcacatattagaagaaatgtcatacgacaatgcagtagatattttaaatgagttgactaaaccaaaagttgctagtcttttaacattgatgaataaagatgacgcgaatgaaatcaaagcattacttcactatgatgaggatacggccggcggtattatgacgacggagtatttatcacttaaagcgcatacgcctgttaaagaagcattattattggtcaaagcgcaagcaccagacgcagaaacaatatatgttatatttgtcgttgatgatgatggtaaattagtaggtgttttatcgctaagagatttaattgtagctgaaaatgatgcttatattgaagatattatgaatgaacgtgtcattagtgtgaatgtagcagacgaccaagaagatgttgctcaagttatgagagactatgatttcatggctgtacctgttatagattaccaagaacatttgcttggtatcatcacgattgatgatattttagacgttatggatgaagaggctagtgaagactactctcgtttagccggggtatcagatatcgattcgactaatgattcaatcattaaaacagcattaaaacgtttaccatggttgattattttaacatttttaggaatgattactgcgacaattttagggagattcgaaaaaacattagaaaatgtagcgctactcgcagcgtttattcctattattagtggtatgtcaggaaattcaggtacacaatctttagccgtttcagttcgtaacattacgacaggggaaattaatgagcaaagtaaatttagaattgcattaagagaagcaggaagtggtgtattatcgggtgttgtatgttcaacaatattatttacaattattgttgcaatatatcatcagccacttttagcattaatcgttgcaggaagtttaacttgtgcgatgacggtggggacgtttgtaggttcgatgattccattattgatgaataaattaaatatcgatccagcagtggctagtggaccatttattacaacaattaatgatattattagtatgttgatttattttggtttagctacatcatttatggcttacttaatt

SEQ ID NO: 4854 - protein, 461 aa, Staphylococcus aureus
  MISC_FEATURE (1)..(461): hypothetical protein
MSMNTDEKERVQEELYDQTLLDQYLENDDIDQFRDEFLALHTYEQSEYFEDTTDENRQKIFQYLSPEEVANFFDQLDIDDDEYELLFDKMNATYASHILEEMSYDNAVDILNELTKPKVASLLTLMNKDDANEIKALLHYDEDTAGGIMTTEYLSLKAHTPVKEALLLVKAQAPDAETIYVIFVVDDDGKLVGVLSLRDLIVAENDAYIEDIMNERVISVNVADDQEDVAQVMRDYDFMAVPVIDYQEHLLGIITIDDILDVMDEEASEDYSRLAGVSDIDSTNDSIIKTALKRLPWLIILTFLGMITATILGRFEKTLENVALLAAFIPIISGMSGNSGTQSLAVSVRNITTGEINEQSKFRIALREAGSGVLSGVVCSTILFTIIVAIYHQPLLALIVAGSLTCAMTVGTFVGSMIPLLMNKLNIDPAVASGPFITTINDIISMLIYFGLATSFMAYLI

SEQ ID NO: 4855 - DNA, 852 bp, Staphylococcus aureus
atgaaatttaagtatcatatatcacaacaagaaactgttaaaacttttttagcacgacatgatttttctaagaagacagtgagcgccattaaaaataatggcgctttaattgttaatgatgaaccagtcacagtgcgtaagcaattaatgacaaatgatatattagaaattcatttaccgcgagaaataccgagtgttaatttaataccttatgctcgtaagctagaagtattgtatgaagatgcttttatcatcatagttactaaaccaaacaatcaaaattgtacgccttcgagagaacatcctcatgaaagtttaatcgaacaagtactatatcattgtcaggaacatggtgaaaatattaacccacatattgttacgcgtctagatcgtaatacaactggtattgtgatattcgctaaatatggacatatccatcatttattttctaaagtaaacttgaaaaaaatatatacttgccttgtatatggtaaaacccatacatctggtattattgaagctaatattagacggtcaaaggataggattataactagagaagttgcctcggatggtaaatacgctaaaacatcttatgaagtaataaatcagaatgataaatacagtttatgcaaagttcatttgcatacgggacgtacacatcaaattcgtgtacattttcaacatattgggcatccaattgtgggagattctttgtatgatggttttcatgacaaaattcatggtcaagtactgcaatgtacgcaaatatattttgttcatccaatcaataagaacaatatttatattacaattgattataagcaattacttaaattattcaatcaactc

SEQ ID NO: 4856 - protein, 284 aa, Staphylococcus aureus
  MISC_FEATURE (1)..(284): conserved hypothetical
MKFKYHISQQETVKTFLARHDFSKKTVSAIKNNGALIVNDEPVTVRKQLMTNDILEIHLPREIPSVNLIPYARKLEVLYEDAFIIIVTKPNNQNCTPSREHPHESLIEQVLYHCQEHGENINPHIVTRLDRNTTGIVIFAKYGHIHHLFSKVNLKKIYTCLVYGKTHTSGIIEANIRRSKDRIITREVASDGKYAKTSYEVINQNDKYSLCKVHLHTGRTHQIRVHFQHIGHPIVGDSLYDGFHDKIHGQVLQCTQIYFVHPINKNNIYITIDYKQLLKLFNQL

SEQ ID NO: 4857 - DNA, 807 bp, Staphylococcus aureus
atgcgttatacaattttaactaaaggtgactccaagtctaatgccttaaagcataaaatgatgaactatatgaaagattttcgcatgattgaggatagtgaaaatcctgaaattgttatttcagttggtggtgacggtacattactacaagcattccatcagtatagccacatgttatcaaaagtggcatttgttggagttcatacaggtcatttaggattttatgcggattggttacctcatgaagttgaaaaattaatcatcgaaattaataattcagagtttcaggtcattgaatatccattgcttgaaattattatgagatacaacgacaacggctatgaaacaaggtatttagcattaaatgaagcaacgatgaaaactgaaaatggctcaacacttgttgtggatgttaacttaagagggaaacactttgagcgatttagaggcgatggattatgtgtatcaacaccttcgggttcaacggcttataacaaagcgctaggtggcgcactgatacatccttcacttgaagcaatgcaaattacagaaattgcctcgataaataatcgtgtgtttagaacggtaggatcaccacttgtattaccaaagcatcatacatgtttaatatcaccagttaatcatgataccattagaatgacgatagatcatgttagtatcaaacataaaaatgttaattcaatacaataccgtgtagcaaatgaaaaagtgaggtttgcacgttttagaccattcccattctggaaacgtgtgcacgattctttcatatcaagtgatgaagaacga

SEQ ID NO: 4858 - protein, 269 aa, Staphylococcus aureus
  MISC_FEATURE (1)..(269): conserved hypothetical
MRYTILTKGDSKSNALKHKMMNYMKDFRMIEDSENPEIVISVGGDGTLLQAFHQYSHMLSKVAFVGVHTGHLGFYADWLPHEVEKLIIEINNSEFQVIEYPLLEIIMRYNDNGYETRYLALNEATMKTENGSTLVVDVNLRGKHFERFRGDGLCVSTPSGSTAYNKALGGALIHPSLEAMQITEIASINNRVFRTVGSPLVLPKHHTCLISPVNHDTIRMTIDHVSIKHKNVNSIQYRVANEKVRFARFRPFPFWKRVHDSFISSDEER

SEQ ID NO: 4859 - DNA, 633 bp, Staphylococcus aureus
atgaatcaatgggatcagttcttaacaccttataagcaagcggttgatgagttgaaagtgaaacttaaaggcatgcgcaaacaatatgaagttggtgaacaagcgtcgccaatagaatttgttactggtcgtgttaaaccaatcgctagtattatagataaggcaaacaaacgacaaataccatttgataggttaagagaagaaatgtacgatatcgctggtttaagaatgatgtgccaatttgttgaagatattgatgttgtcgtcaatattttaagacaaagaaaagattttaaagtaattgaagaacgagattatattcgtaacactaaagaaagtggttaccgctcgtatcatgtcattattgaatatccaattgaaacattacaaggccaaaaatttatattggctgagattcagattcgtacattagcaatgaatttctgggcaacgattgaacatactttacgatataaatatgatggtgcttatccggatgaaattcaacatcgtttggaaagagcggcagaagcagcgtatttacttgatgaagagatgtctgaaattaaagatgaaattcaggaagctcaaaaatattacacgcaaaaacgttctaaaaaacatgaaaatgat

SEQ ID NO: 4860 - protein, 211 aa, Staphylococcus aureus
  MISC_FEATURE (1)..(211): GTP pyrophosphokinase
MNQWDQFLTPYKQAVDELKVKLKGMRKQYEVGEQASPIEFVTGRVKPIASIIDKANKRQIPFDRLREEMYDIAGLRMMCQFVEDIDVVVNILRQRKDFKVIEERDYIRNTKESGYRSYHVIIEYPIETLQGQKFILAEIQIRTLAMNFWATIEHTLRYKYDGAYPDEIQHRLERAAEAAYLLDEEMSEIKDEIQEAQKYYTQKRSKKHEND

SEQ ID NO: 4861 - DNA, 381 bp, Staphylococcus aureus
gtgttaaaatgttatggaataagaggaggattaagcatgcgtttatatattaatgaaattaaaattaaagatgacatactttattgttatacagaagattctattaaaggattatctgaagtaggacaaatgctcgttgatagtgataattatgcctttgcgtatacattagatgatggtaaagcgtatgcttatctcattttcgtacaagaaacatggacgatgttgcatgaaaacatgactaaaaaaattattatcaatgatgaactagaattgactgaattccaccaagaacttacttatattttagacaacataaaagggaataataattatggtaaggaatttgttgcaaccgttgaagaaacattcgacattgaa

SEQ ID NO: 4862 - protein, 127 aa, Staphylococcus aureus
  MISC_FEATURE (1)..(127): conserved hypothetical
VLKCYGIRGGLSMRLYINEIKIKDDILYCYTEDSIKGLSEVGQMLVDSDNYAFAYTLDDGKAYAYLIFVQETWTMLHENMTKKIIINDELELTEFHQELTYILDNIKGNNNYGKEFVATVEETFDIE

SEQ ID NO: 4863 - DNA, 591 bp, Staphylococcus aureus
atggcaacaaatcatgaaatagaatttaaacaaatgataactgcatcaatctataataaattgcaagagaaatattttaaagacagtgtgctttttaagcaagtcaattactatattgatacacccgatttcaaattaaaggaacatcgctctgcactacgcataagagttaaagacaatcaatatgaaatgactttaaagacaccagcaaaggttggtctattagaatacaactatatcgtcgacattaaaccagagatgaacttgattatttcaaacgacaatcttccagatgacattcgtcaaattatagttgaacagtttggtgtaaaagatacaactttatcaatacttggtgcattaacgacatatcgccaagaaactaaatataaaggtgatttactggttttagataaaagtgagtatttcgatactacggattatgagttagagttcgaagttaaagactataatcaaggtttacaaaagttccaatctttattaaacgaactaaacctcgaacatcatcaacctttaaataaagttcaacgttttttcaagaaaaaagaaacactttcaaacaatataaat

SEQ ID NO: 4864 - protein, 197 aa, Staphylococcus aureus
  MISC_FEATURE (1)..(197): conserved hypothetical
MATNHEIEFKQMITASIYNKLQEKYFKDSVLFKQVNYYIDTPDFKLKEHRSALRIRVKDNQYEMTLKTPAKVGLLEYNYIVDIKPEMNLIISNDNLPDDIRQIIVEQFGVKDTTLSILGALTTYRQETKYKGDLLVLDKSEYFDTTDYELEFEVKDYNQGLQKFQSLLNELNLEHHQPLNKVQRFFKKKETLSNNIN

SEQ ID NO: 4865 - DNA, 363 bp, Staphylococcus aureus
atgacaacaacaccatatgacatcattggtaaagaagcgttatacgatatgattgattatttttacacccttgtagaaaaagatgaacgacttaatcacctgtttccaggagattttgcagaaacaagtcgtaaacaaaaacaatttttaacacagtttttgggcggtccaaacatttataccgaagaacacggacatcctatgctaagaaaaagacatatagattttacaatcactgaatttgaaagagatgcatggttagaaaatatgcagacagcaattaatcgcgctgcgtttccacaaggtgttggagattatttatttgagcgcttaagattaactgctaatcatatggtgaattcc

SEQ ID NO: 4866 - protein, 121 aa, Staphylococcus aureus
  MISC_FEATURE (1)..(121): conserved hypothetical
MTTTPYDIIGKEALYDMIDYFYTLVEKDERLNHLFPGDFAETSRKQKQFLTQFLGGPNIYTEEHGHPMLRKRHIDFTITEFERDAWLENMQTAINRAAFPQGVGDYLFERLRLTANHMVNS

SEQ ID NO: 4867 - DNA, 804 bp, Staphylococcus aureus
atggctggagaattacgaataatggaaaataagagtcgtgaagatatcaatctatcacctgtaagtaaaatcgaaatttattcatttttcgatccatttagctccgattgcttcaaattatcagcaatcttatccaaattaagaattgaatataatcaatatatacgtatcagacatatattaaatccttcgttaaaagtattaacgaaatgccaagctcaaagtacatccaactttgataacatcgccctagcttataaagcagctgagttacaaggtcgtgtacgtgccgaacgatttatacatttaatgcaaaatgaaatcatacctaaaagagatattattacagaatcaatgatttgtgactgtattcaaaatgcaggtattgatttagaagtatttaaagacgacttacaaaaaagtaaactaaccgaaagcttgaaaattgatttgcatattgcaagagaaatggaaatcgaacaagccccttctctcgttttctttagtgaagatgttcatgaagaaggtttaaaagtcgaaggattatacccatatcacatctatacttatataattaatgaattgatgggtaaacctatcgaaaagaatcttcctcctaaattagaaacttatatacagcaacaacaacttgtaacgatggaagaattacttactatttatgaatggccagaaaaacttttaaacaaagagttaaagaagttagccattcaacaaaaaattgaaaaacttaaatatccagatggcgatttctggaaatctaaaatgcctaaaatcaaatcaaaa

SEQ ID NO: 4868 - protein, 268 aa, Staphylococcus aureus
  MISC_FEATURE (1)..(268): GTP pyrophosphokinase
MAGELRIMENKSREDINLSPVSKIEIYSFFDPFSSDCFKLSAILSKLRIEYNQYIRIRHILNPSLKVLTKCQAQSTSNFDNIALAYKAAELQGRVRAERFIHLMQNEIIPKRDIITESMICDCIQNAGIDLEVFKDDLQKSKLTESLKIDLHIAREMEIEQAPSLVFFSEDVHEEGLKVEGLYPYHIYTYIINELMGKPIEKNLPPKLETYIQQQQLVTMEELLTIYEWPEKLLNKELKKLAIQQKIEKLKYPDGDFWKSKMPKIKSK

SEQ ID NO: 4869 - DNA, 231 bp, Staphylococcus aureus
gtggaaaatttcgataaagtaaaagatatcatcgttgaccgtttaggtgtagacgctgataaagtaactgaagatgcatctttcaaagatgatttaggcgctgactcacttgatatcgctgaattagtaatggaattagaagacgagtttggtactgaaattcctgatgaagaagctgaaaaaatcaacactgttggtgatgctgttaaatttattaacagtcttgaaaaa

SEQ ID NO: 4870 - protein, 77 aa, Staphylococcus aureus
  MISC_FEATURE (1)..(77): HmrB protein
VENFDKVKDIIVDRLGVDADKVTEDASFKDDLGADSLDIAELVMELEDEFGTEIPDEEAEKINTVGDAVKFINSLEK

SEQ ID NO: 4871 - DNA, 1806 bp, Staphylococcus aureus
atgagtcaacaattatcgagagaagaacaggaacgtaaatatcctgaatatacatgggacttaacaacaattttcaaagatgatgaagcttttgaggctgcatttaaagaagttgaaaatgagttaggcaaagaagaacaatttaaaggacacattggtgatagtgctgagacattatacaatgcgttagaattagaagatacattaggtactaaattagaaaaagtatatgtatacgcgcacctaaaacaagaccaagatacaacgaacgacaagtatactggtatggagtcaagagcacatcaattaattattaaatttagctcggcatggagtttcttagtgccagagattttacaaattgatgaagataaaattcaatcatttgtaaattcatatgataaattacaaaaattcgcatttgatttgaagttgattaatgaaaaacgtcctcatattttagatgctgaaactgaaaagttattaacagaagcgcaggacgcgttatcaacgccatcaaatgtatacggtatgtttagcaacgctgatttagtatttgaagatgcgatagataaagatggaaatgcacacccgttaacacaaggtacatttattaagtatttagaaacagatgatcgcaaactaagagaaagtgcttttagaaatgtatataaagcatatggtgctcataataatacgcttggcgctacgctagcaggtgaagtgaagaaaaatgtatttaatgctcgtacacacaattacaaaactgcaagagaaaaagcattgagtaataatcatattccagaaaatgtatatgacaatctagtaaaaactgtacataaatatttaccattgctacatagatatactgaattgcgcaaagaattgctaggtttagatgacttgaaaatgtatgatttatatacaccattaattaaagatattaagtttgaaatgccttatgaagaagctaaagagtggatgttaaaagcattagaaccaatgggtgaagaatatttaaatgtagttaaagaaggcttaaacaatcgttgggtcgatgtctatgagaataaaggtaaacgttcaggtggctattcatcaggtgcacatttaactaatccatttattctacttaactggtctaatactatttcagacttatacacattagttcatgaatttgggcattcagcacatagttacttcagtagaaaattccaaccgtcaaattctagtgactacactatttttgtcgctgaagttgcatcaacttgtaacgaagcacttttaagtgattatatggataaacatcttgatgatgaaaaacgcttattattattaaaccaagaattagaacgtttcagagctacattattccgacaaacaatgttcgcagaatttgagcataaaattcatgcaattgaagaagcaggtgaaccattaacgccaactagaatgaatgaagaatatgccaaattaaataaattatacttcggtgattctgtagaaactgatgaagatattagtaaggaatggtcacgtattccacacttctatatgaattattatgtatatcaatacgcaactggttacagtgcagctcaaagcttaagtcatcaaattttaacagaaggtaagccagcagtagatagatatattaatgaattcttgaaaaaaggtagctcaaattatccaattgagatattaaaaaatgctggtgtagatatgacaacacctgaaccaattgaacaagcttgtgaagtttttgaacaaaaattgaacgcttttgaaaaattaatgaaagct

SEQ ID NO: 4872 - protein, 602 aa, Staphylococcus aureus
  MISC_FEATURE (1)..(602): thimet oligopeptidase
MSQQLSREEQERKYPEYTWDLTTIFKDDEAFEAAFKEVENELGKEEQFKGHIGDSAETLYNALELEDTLGTKLEKVYVYAHLKQDQDTTNDKYTGMESRAHQLIIKFSSAWSFLVPEILQIDEDKIQSFVNSYDKLQKFAFDLKLINEKRPHILDAETEKLLTEAQDALSTPSNVYGMFSNADLVFEDAIDKDGNAHPLTQGTFIKYLETDDRKLRESAFRNVYKAYGAHNNTLGATLAGEVKKNVFNARTHNYKTAREKALSNNHIPENVYDNLVKTVHKYLPLLHRYTELRKELLGLDDLKMYDLYTPLIKDIKFEMPYEEAKEWMLKALEPMGEEYLNVVKEGLNNRWVDVYENKGKRSGGYSSGAHLTNPFILLNWSNTISDLYTLVHEFGHSAHSYFSRKFQPSNSSDYTIFVAEVASTCNEALLSDYMDKHLDDEKRLLLLNQELERFRATLFRQTMFAEFEHKIHAIEEAGEPLTPTRMNEEYAKLNKLYFGDSVETDEDISKEWSRIPHFYMNYYVYQYATGYSAAQSLSHQILTEGKPAVDRYINEFLKKGSSNYPIEILKNAGVDMTTPEPIEQACEVFEQKLNAFEKLMKA

SEQ ID NO: 4873 - DNA, 984 bp, Staphylococcus aureus
atgttagtagctttaaatgaagaaaaggaacgcgtattagcaactactgcattgagaaagacacaatatttttgtccggtgtgtggcaagcaagttattttaaagcgtgggctcaaagtaattagtcattttgcacataaacatttagcggaacaaaaatgttttaataatgaaacgattaaacattataaaagtaaattgattttagcacagatgatacagcaacaaggatgtaaagtagagatagagccatttttaaaagaaataaaacaaattccggatattttgattaataataaatatgttattgagctacagtattcgccaattccttataaacagattcttcaacgaacggaaggtttaaagaaaatgggatataaagtaagttggttattaaatgatgttgattattgtcataataaagtgaagttcaatcattttcaaagtatgtttattaatccattcactcgaaaacttcatacgttcaatttagagaaaaaacaaataatgatgtttcaacaaatacaatatttaggcgggcacaaatatgtcgctgaaaaaagaaatgccaaaattagtgagttgtttaatgaggcgccttgtgattatcatgctgtttataaattatcaaagttcgcaattaatcaatatatcaaatattgtcgctggcaaaattctgttttagaacccactttaagtgcaatgtatcaattacagttaactgatcaagaagtagtgcacaattatggttatatttttccagagcaaatttatattaaaaatcatcctattgagtggcaattacaagttgatttatggttaaagaatggaaaaagcaaattagtaaatgacaatcttaattattttaaactgaaaaaatttattgttgctctagaaagtaaaacagcaattatagaaaaacttattaacaattatttaaatatttgttcagataaaggtaatgacgtgcaaattttgttc

SEQ ID NO: 4874 - protein, 328 aa, Staphylococcus aureus
  MISC_FEATURE (1)..(328): hypothetical protein
MLVALNEEKERVLATTALRKTQYFCPVCGKQVILKRGLKVISHFAHKHLAEQKCFNNETIKHYKSKLILAQMIQQQGCKVEIEPFLKEIKQIPDILINNKYVIELQYSPIPYKQILQRTEGLKKMGYKVSWLLNDVDYCHNKVKFNHFQSMFINPFTRKLHTFNLEKKQIMMFQQIQYLGGHKYVAEKRNAKISELFNEAPCDYHAVYKLSKFAINQYIKYCRWQNSVLEPTLSAMYQLQLTDQEVVHNYGYIFPEQIYIKNHPIEWQLQVDLWLKNGKSKLVNDNLNYFKLKKFIVALESKTAIIEKLINNYLNICSDKGNDVQILF

SEQ ID NO: 4875 - DNA, 717 bp, Staphylococcus aureus
atgagaatagaacgagtagatgatacaactgtaaaattgtttataacatatagcgatatcgaggcccgtggatttagtcgtgaagatttatggacaaatcgcaaacgtggcgaagaattcttttggtcaatgatggatgaaattaacgaagaagaagattttgttgtagaaggtccattatggattcaagtacatgcctttgaaaaaggtgtcgaagtcacaatttctaaatctaaaaatgaagatatgatgaatatgtctgatgatgatgcaactgatcaatttgatgaacaagttcaagaattgttagctcaaacattagaaggtgaagatcaattagaagaattattcgagcaacgaacaaaagaaaaagaagctcaaggttctaaacgtcaaaagtcttcagcacgtaaaaatacaagaacaatcattgtgaaatttaacgatttagaagatgttattaattatgcatatcatagcaatccaataactacagagtttgaagatttgttatatatggttgatggtacttattattatgctgtatattttgatagtcatgttgatcaagaagtcattaatgatagttacagtcaattgcttgaatttgcttatccaacagacagaacagaagtttatttaaatgactatgctaaaataattatgagtcataacgtaacagctcaagttcgacgttattttccagagacaactgaa

SEQ ID NO: 4876 - protein, 239 aa, Staphylococcus aureus
  MISC_FEATURE (1)..(239): hypothetical protein
MRIERVDDTTVKLFITYSDIEARGFSREDLWTNRKRGEEFFWSMMDEINEEEDFVVEGPLWIQVHAFEKGVEVTISKSKNEDMMNMSDDDATDQFDEQVQELLAQTLEGEDQLEELFEQRTKEKEAQGSKRQKSSARKNTRTIIVKFNDLEDVINYAYHSNPITTEFEDLLYMVDGTYYYAVYFDSHVDQEVINDSYSQLLEFAYPTDRTEVYLNDYAKIIMSHNVTAQVRRYFPETTE

SEQ ID NO: 4877 - DNA, 429 bp, Staphylococcus aureus
atgaattttattcattcaaataggagagtgagatgtatggtaacattatttacttcaccaagttgcacatcttgccgtaaagcgaaagcatggttacaagaacatgacattccgtatacggagcgtaatattttttctgaacatttaacaattgatgaaattaagcaaatattaaaaatgactgaagacggtactgatgaaatcatttctacacgttctaaaacataccaaaaattaaatgttgatattgattcactaccattacaagacttatattcaatcattcaagataatcctggcttattacgtcgtccaattattttagataataaacgactacaagttggttataatgaggacgagattcgacgtttcttacctagaaaagttcgtacgttccaattacaagaagcacaacgtatggttgac

SEQ ID NO: 4878 - protein, 143 aa, Staphylococcus aureus
  MISC_FEATURE (1)..(143): conserved hypothetical
MNFIHSNRRVRCMVTLFTSPSCTSCRKAKAWLQEHDIPYTERNIFSEHLTIDEIKQILKMTEDGTDEIISTRSKTYQKLNVDIDSLPLQDLYSIIQDNPGLLRRPIILDNKRLQVGYNEDEIRRFLPRKVRTFQLQEAQRMVD

SEQ ID NO: 4879 - DNA, 987 bp, Staphylococcus aureus
atggagacattattttcaggcatccaacctagtggaattcctactattggaaattatattggcgcactaaaacaatttgttgatgtgcaaaatgactatgattgttatttctgtatcgtagatcaacatgcaattacaatgccacaagatcgtttaaaattacgtaaacagaccagacaattagcagcgatttatttagcttctggtatagatccagacaaagcaacattgttcatacaatctgaagtccctgcacacgtacaagcaggatggatgttaactacgattgcttctgttggagaattagagcgtatgacgcaatacaaagataaagctcagaaagcagttgaaggtatacctgctggtctattaacatatccacctttaatggcagctgatattgttctttacaatactaatatcgttccagttggagatgaccaaaagcagcatatcgaattgactcgtaaccttgtagatagatttaatagtcgctataatgatgtgcttgtgaaacctgaaattcgtatgcctaaagttggtggacgtgtcatgagtttacaagacccaacaagaaaaatgagtaagagtgatgataatgctaaaaacttcatttcattattagacgagccgaatgttgcagctaaaaaaattaaaagcgcagtaactgattcagatggtattattaaatttgatcgtgacaacaagccaggtataacaaatttaatttcaatatacgctggattaacagacatgccaattaaagatattgaggcaaaatatgagggcgaaggttatggtaaatttaaaggtgaccttgctgaaatagttaaagcatttttagtagaattccaagaaaaatacgaaagtttctataactcagataaacttgatgatattttagatcaaggtagagataaagcacacaaagtttcatttaaaactgtcaaaaaaatggaaaaagcgatgggtttaggacgtaagaga

SEQ ID NO: 4880 - protein, 329 aa, Staphylococcus aureus
  MISC_FEATURE (1)..(329): tryptophanyl-tRNA
METLFSGIQPSGIPTIGNYIGALKQFVDVQNDYDCYFCIVDQHAITMPQDRLKLRKQTRQLAAIYLASGIDPDKATLFIQSEVPAHVQAGWMLTTIASVGELERMTQYKDKAQKAVEGIPAGLLTYPPLMAADIVLYNTNIVPVGDDQKQHIELTRNLVDRFNSRYNDVLVKPEIRMPKVGGRVMSLQDPTRKMSKSDDNAKNFISLLDEPNVAAKKIKSAVTDSDGIIKFDRDNKPGITNLISIYAGLTDMPIKDIEAKYEGEGYGKFKGDLAEIVKAFLVEFQEKYESFYNSDKLDDILDQGRDKAHKVSFKTVKKMEKAMGLGRKR

SEQ ID NO: 4881 - DNA, 879 bp, Staphylococcus aureus
atgcaaaataagtcaaaatcgccttttaaaattgcattttctaaatttattcataataaaattgcaatgttatcggttatttttttattaatcataactattgtatcaattatagcgccattaatagctccttttccagtgaaccaacaagatttattaaatataaaaggtgaaatgacagcacaaaacattcttggtacagactctggtggtagggataactttagtcgtttgttatatgcaggtcgtatttcattatccattggaattacatctacaataggaatgcttttgattggaattacagttggagtgatttctggttattttggaggtattgttgatacattattaatgagaataaccgaatttgttatgttatttccatttttaatatttgcaattgtattaaatgctgcacttggagataaaattaaaaatccttatggatctgccataattcttgttctagttattatcgtattaagttggggaggtattgcaagacttgttcgtggtaaagtacttcaagaaaaagaaaatgaatactttttggcagcaaaatcaattggtacacccacatataaaattattttgaaacatcttttgccgaatatattaagtgtagttatcgtacaagcaacattgttatttgccggtatgattgtagtggaatcaggattgagctttttaggattcggaattagtaaagcaataccatcttggggtaatatgttgagtgatgctcaagaaggggatgttataagtggtaaaccgtggatatggatgccacctgctataatgattacattaactatattaagtataaactttgtaggggaagggattaaagatgcttttaatcctagaggtagacgt

SEQ ID NO: 4882 - protein, 293 aa, Staphylococcus aureus
  MISC_FEATURE (1)..(293): hypothetical protein
MQNKSKSPFKIAFSKFIHNKIAMLSVIFLLIITIVSIIAPLIAPFPVNQQDLLNIKGEMTAQNILGTDSGGRDNFSRLLYAGRISLSIGITSTIGMLLIGITVGVISGYFGGIVDTLLMRITEFVMLFPFLIFAIVLNAALGDKIKNPYGSAIILVLVIIVLSWGGIARLVRGKVLQEKENEYFLAAKSIGTPTYKIILKHLLPNILSVVIVQATLLFAGMIVVESGLSFLGFGISKAIPSWGNMLSDAQEGDVISGKPWIWMPPAIMITLTILSINFVGEGIKDAFNPRGRR

SEQ ID NO: 4883 - DNA, 960 bp, Staphylococcus aureus
atgattaaattaatacttaaaagattagggttaatgatcccgttactaattttaatctcaatagttgtattttcattagcaatcatacaaccaggagatccattttcagatctacaaaacggtaaaataaaacaagaagcaataaatgcacaaagggaaaaattaggtctcaacgactcaataccacatcaatacattagatgggtcaatcatgttatacacggtgatttaggggagtcaatcaaatataaaaggccggtaattgatgttattgaggaaagaattccaaatacaatattactcggtgctatgtcattaattattacttatattatctcatttgctttaggaataacgtcaggtagatattcttacagtttgacggattatactgtgcaaatatttaattatttgatgttagccattccatcttttattgcgggagtatttgcaatttttattttttcttttgaattacaatggttcccgtttcaaggttctgttgatattaaccttaaagaaggtacttttgaatattatatgagtaaaatatatcacacatttttacctgcattcactttaggtttattatctactgctggttatattcaatatttacgtaatgatattattgaaaattctaaaaaagattatgtattgacggcaaggtcaaaaggattatctatgaataaaatttataataaacatatattgagaaattctctaatacctattattacatttttaggtgctgatattgtaagtattttaggtggagccgtgattacggagactatcttttcatataacggtatcggtaaattatttttagaatcggtaataggccaagactatccattaatgatggcattaacgttatttttctcatttttaggtttactgggtaatttgatttctgatattacttatggatttatagatccaagaattagaagtaac

SEQ ID NO: 4884 - protein, 320 aa, Staphylococcus aureus
  MISC_FEATURE (1)..(320): probable oligopeptide
MIKLILKRLGLMIPLLILISIVVFSLAIIQPGDPFSDLQNGKIKQEAINAQREKLGLNDSIPHQYIRWVNHVIHGDLGESIKYKRPVIDVIEERIPNTILLGAMSLIITYIISFALGITSGRYSYSLTDYTVQIFNYLMLAIPSFIAGVFAIFIFSFELQWFPFQGSVDINLKEGTFEYYMSKIYHTFLPAFTLGLLSTAGYIQYLRNDIIENSKKDYVLTARSKGLSMNKIYNKHILRNSLIPIITFLGADIVSILGGAVITETIFSYNGIGKLFLESVIGQDYPLMMALTLFFSFLGLLGNLISDITYGFIDPRIRSN

SEQ ID NO: 4885 - DNA, 978 bp, Staphylococcus aureus
atggaaaatattttagaagtcaaccaaataaaaaaatactacaaaattaaaactggattattacaaaaaactcagtacgttaaagctgttgatgacgtatcgttttcaataaaaaaaggacaaacttttggattagtaggagaatcgggttgtggtaagtcaacgttaggtaaagtgattatcaggcttgaagatgcaacttcaggctcaataattgttaatggtgaagatataacaagattacaaggtaaaaaactcagaaaatcacgacaacaatatcagatgatatttcaagatccgtatgcatcattgaatccgatgcaaatggttggagatatcatttcagaacctattttaaattataaaaaattgccaaaagaagaaataaaaaaagaagtactatatttattaaaatgtgttggcctaagtgaagatgcatattataaatatgcacatgaattttcaggtggacagagacaaagagtgggaattgcaagagcattggctttgcgtccgagtttaattgttgctgatgagcctgtaagtgcattagatgtatctgttcaatctcaagtactgaatttattaaaagatttacaagaacaatttaacttaagctatttatttatcgcacatgatttaagtgtagtaaaacatataagtgatgtcattggagttatgtatttaggtcatatagttgaaatcgcatctgataaagaaatttatgaaaatcccaaacatccatatacaaaagcgttgatttcatcaataccacaaattgataaacataataacaatagaattatattaaaaggagaattaccttcgccaagtaatccgccgcaaggttgtccttttcatacaagatgtccaattgctcaagatatgtgcaaaaaaagtatgccagaattaaaggacattggtaatgaacatcaagttgcttgtttctacgtagataaagtaggtgatttaaatgat

SEQ ID NO: 4886 - protein, 326 aa, Staphylococcus aureus
  MISC_FEATURE (1)..(326): oligopeptide transport
MENILEVNQIKKYYKIKTGLLQKTQYVKAVDDVSFSIKKGQTFGLVGESGCGKSTLGKVIIRLEDATSGSIIVNGEDITRLQGKKLRKSRQQYQMIFQDPYASLNPMQMVGDIISEPILNYKKLPKEEIKKEVLYLLKCVGLSEDAYYKYAHEFSGGQRQRVGIARALALRPSLIVADEPVSALDVSVQSQVLNLLKDLQEQFNLSYLFIAHDLSVVKHISDVIGVMYLGHIVEIASDKEIYENPKHPYTKALISSIPQIDKHNNNRIILKGELPSPSNPPQGCPFHTRCPIAQDMCKKSMPELKDIGNEHQVACFYVDKVGDLND

SEQ ID NO: 4887 - DNA, 984 bp, Staphylococcus aureus
atgaataatgtattgttagaggttaaagatttagaaacatcattaaaaataaataatgaatggttagcaactgttgaaaatatttcttttgaattatctaaaggagaagttttgggtatagtaggggaatctggttgcggtaagtccatattaagtaagtcaattattaaattattaccagaaaagatatctaaactaagtaatggagaagttatatttgatggtaaacgaatcgatacgctcaatgagaagcaattgctagatattcgaggaaatgatattgctatgatttttcaagaacctatgactgctttaaatcctgtatttaccataaaaaatcaacttgtggaatctataaaatcacataaaaaaatttctaaaaaagaagcaaataaattagcaaaagatttactaaaaaaagttggaattgctagacaagatgaaatattaaatagctatcctcatcaattatctggtggtatgagacaaagagtaatgattgcaatggccatttcatgttctcctaaattattaattgctgatgaacctacaacagcattggatgtcacgattcaagcgcaaatattagacttattaaaagaattgcaaaaggaaacgcaaatggcaattatgatgattacacatgatttgagtgtagttgctgagttttgcgataaagtcttagttatgtatgcaggtcaaattgtagaatttggaggcataaaagaaatactacacaatccgaaacatccttatacccaaaaattattatcaacaattccaaaacttaaagaagagcagaaacgacttgaaacgatagaaggaattgtgccatcaatccaagcatttcacgttaataagtgcagatttgcaaatagatgtaacaaaaaactggatatttgtaataatcaatctcctaaaatgcatgtttgtgaagacgtcattgtacgttgtcatttgtacaaaaatgaatataaggagata

SEQ ID NO: 4888 - protein, 328 aa, Staphylococcus aureus
  MISC_FEATURE (1)..(328): oligopeptide ABC
MNNVLLEVKDLETSLKINNEWLATVENISFELSKGEVLGIVGESGCGKSILSKSIIKLLPEKISKLSNGEVIFDGKRIDTLNEKQLLDIRGNDIAMIFQEPMTALNPVFTIKNQLVESIKSHKKISKKEANKLAKDLLKKVGIARQDEILNSYPHQLSGGMRQRVMIAMAISCSPKLLIADEPTTALDVTIQAQILDLLKELQKETQMAIMMITHDLSVVAEFCDKVLVMYAGQIVEFGGIKEILHNPKHPYTQKLLSTIPKLKEEQKRLETIEGIVPSIQAFHVNKCRFANRCNKKLDICNNQSPKMHVCEDVIVRCHLYKNEYKEI

SEQ ID NO: 4889 - DNA, 1734 bp, Staphylococcus aureus
ttgaaagtaggaggcatatgtatggggaagctaattaaatatatttcaatacttcttattgtcgttttagtgttgagtgcttgcggaaaaagcagtaataaagatgaaggagtaaaagatgctactaaaacggaaacctcaaaacataaaggtggtaccttaaatgtagcattaacagcaccgccaagtggtgtttattcttcgttattaaatagtacacatgcagattctgtagttgagggatattttaacgaaagcttattagcaactgataaaaaaatacgtcctaaggcatatattgcttcatggaaggacatcgagccggctaagaaaatagaatttaaaattaaaaaaggtattaaatggcatgatggtaatgaattgaaaattgatgattggatttattcaattgaagtcttagctaacaaggactacgaaggtgcttattatccaagtgtagaaaatatccaaggtgcgaaagattatcatgaaggaaaaactgatcatattagcggattgaagaaaatagatgactacactatgcaggttacatttgataaaaaacaagaaaattacttaacaggatttattactggacctttattaagtaaaaaatatttatcagatgtaccaattaaagatttagcgaaatcagataaaatccgaaaatatcctattggtattggaccgtataaagttaagaaaatcgttccaggtgaggctgttcaactcgttaaatttgatgattattggcaaggtaagcctgcactagacaaaatcaatttaaaagttattgatcaagcgcaaattattaaggcaatggaaaaaggcgatattgatgttgcgaatgatgctaccggtgcaatggcaaaagatgctaagtcatctaatgctggtctcaaggtattatctgcgccaagcttagactacggtttaataggattcgtatctcatgattacgataaaaaagctaataaaactggtaaagtgagaccaaaatatgaagacaaagaattacgtaaagcaatgctttatgcaattgatagagaaaaatggatcaaagcgtttttcaatggttacgctagtgaaatcaatagttttgtaccatctatgcattggatagcagccaatcctaaggacctaaatgattacaaatatgatcctgaaaaagctaaaaaaatcttagataagttaggttataaagatagagatggtgacggatttagagaagatcctaaaggtaataaatttgagattaactttaaacataattcaggttctaatcctacttttgaaccaagaactgctgcgataaaagatttctgggaaaaagttggcttgaaaacaaatgtgaagttagtagaattcggtaaatataatgaagacttagcaaatgcatctaaagatatggaagtgtacttcagatcatgggcaggaggtacagatccagatccatcagatttataccacactgatagacctcaaaatgaaatgagaacagttttaccaaaatcagatcaatatttagatgatgcattagacttcgaaaaagtaggcattgatgaaaagaaacgtaaagatatttatgttaaatggcaaaaatatatgaatgatgagttacctggattaccaatgttccaaggtaaatcgataactattgttaacgataaagtacgaaacttagacattgaaattggaactgatcaaagtttatataatttaactaaagaagct

SEQ ID NO: 4890 - protein, 578 aa, Staphylococcus aureus
  MISC_FEATURE (1)..(578): hypothetical protein
LKVGGICMGKLIKYISILLIVVLVLSACGKSSNKDEGVKDATKTETSKHKGGTLNVALTAPPSGVYSSLLNSTHADSVVEGYFNESLLATDKKIRPKAYIASWKDIEPAKKIEFKIKKGIKWHDGNELKIDDWIYSIEVLANKDYEGAYYPSVENIQGAKDYHEGKTDHISGLKKIDDYTMQVTFDKKQENYLTGFITGPLLSKKYLSDVPIKDLAKSDKIRKYPIGIGPYKVKKIVPGEAVQLVKFDDYWQGKPALDKINLKVIDQAQIIKAMEKGDIDVANDATGAMAKDAKSSNAGLKVLSAPSLDYGLIGFVSHDYDKKANKTGKVRPKYEDKELRKAMLYAIDREKWIKAFFNGYASEINSFVPSMHWIAANPKDLNDYKYDPEKAKKILDKLGYKDRDGDGFREDPKGNKFEINFKHNSGSNPTFEPRTAAIKDFWEKVGLKTNVKLVEFGKYNEDLANASKDMEVYFRSWAGGTDPDPSDLYHTDRPQNEMRTVLPKSDQYLDDALDFEKVGIDEKKRKDIYVKWQKYMNDELPGLPMFQGKSITIVNDKVRNLDIEIGTDQSLYNLTKEA

SEQ ID NO: 4891 - DNA, 738 bp, Staphylococcus aureus
atgaaaatgactaagagtgctttagtaacaggtgcatcaagaggaattggacgtagtattgcgttacaattagcagaagaaggatataatgtagcagtaaactatgcaggcagcaaagagaaagctgaagcagtagtcgaagaaatcaaagctaaaggtgttgacagttttgcgattcaagcaaatgttgccgatgctgatgaagttaaagcaatgattaaagaagtagttagccaatttggttctttagatgttttagtaaataatgcaggtattactcgcgataatttattaatgcgtatgaaagaacaagagtgggatgatgttattgacacaaacttaaaaggtgtatttaactgtatccaaaaagcaacaccacaaatgttaagacaacgtagtggtgctatcatcaatttatcaagtgttgttggagcagtaggtaatccgggacaagcaaactatgttgcaacaaaagcaggtgttattggtttaactaaatctgcggcgcgtgaattagcatctcgtggtatcactgtaaatgcagttgcacctggttttattgtttctgatatgacagatgctttaagtgatgagcttaaagaacaaatgttgactcaaattccgttagcacgttttggtcaagacacagatattgctaatacagtagcgttcttagcatcagacaaagcaaaatatattacaggtcaaacaatccatgtaaatggtggaatgtacatg

SEQ ID NO: 4892 - protein, 246 aa, Staphylococcus aureus
  MISC_FEATURE (1)..(246): 3-oxoacyl-(acyl-carrier
MKMTKSALVTGASRGIGRSIALQLAEEGYNVAVNYAGSKEKAEAVVEEIKAKGVDSFAIQANVADADEVKAMIKEVVSQFGSLDVLVNNAGITRDNLLMRMKEQEWDDVIDTNLKGVFNCIQKATPQMLRQRSGAIINLSSVVGAVGNPGQANYVATKAGVIGLTKSAARELASRGITVNAVAPGFIVSDMTDALSDELKEQMLTQIPLARFGQDTDIANTVAFLASDKAKYITGQTIHVNGGMYM

SEQ ID NO: 4893 - DNA, 1653 bp, Staphylococcus aureus
atgacgagaaaatttagaacacttattttaattttgattgctacaattgcattaagtggttgtgctaatgacgatggtatttattcagataaaggtcaagtattcagaaaaattttgtcatcagacttaacatcccttgatacatcattaataacggatgaaatatcttctgaagtgactgcgcaaacattcgaaggtttatacacattaggaaaaggtgacaaaccggtgttaggtgttgcgaaagcttttcctgaaaagagtaaagatggtaaaactttaaaggttaaattaagaagcgatgctaaatggagcaatggtgacaaagtgactgcacaagactttgtttatgcttggagaaaaacagttgaccctaaaacaggttctgaatttgcatacattatgggggacattaaaaatgcgagtgatattagtactggtaagaaacctgtagagcaattaggtatcaaagcattaaatgatgaaacattacaaattgaattagaaaagccggttccatatattaatcaattattagcacttaatacctttgcacctcaaaatgaaaaagttgccaaaaaatatggtaaaaattacggtacggcagctgatagagcggtatacaatggtccatttaaagttgatgattggaaacaagaagataaaaccttactatctaaaaatcagtattattgggataaaaagaatgtaaaattagataaagtgaattataaagttattaaagacttacaagccggtgcatcattgtatgatactgaatcagtagatgacgcagttattactgcagatcaagtaaataaatataaagacaacaaaggattaaactttgtgttaacgactgggacattttttgtaaaaatgaatgaaaaacaatatcctgattttaaaaacaaaaatttaagattggctatcgcacaagcaatagataaaaaaggatacgttgattcagtgaaaaacaatggctcaattccttccgatacactaacagccaaaggaattgcgaaagcgcctaatggcaaagattatgcgagtaccatgaattcgcctttaaaatataatcctaaagaagcaagagcacactgggacaaagctaaaaaagagttaggtaaaaatgaagtgacattttcaatgaacacagaagatacaccagatgcaaaaatatctgctgaatatatcaaatcgcaagttgagaaaaatttaccaggagttactttgaaaattaagcaattaccgtttaaacaaagagtatcactagaactgagtaacaattttgaagcatcacttagtggttggtctgcagattaccctgatcctatggcttatttagaaacaatgaccacaggtagcgcacaaaataatacagactggggtaataaagaatatgatcaattacttaaagtagcaagaaccaaattggcacttcaaccgaacgaacgatatgaaaacttgaaaaaagcagaagaaatgttcctaggagatgcaccggtagcaccaatttatcaaaaaggtgttgcacatttaacaaatcctcaagtaaaaggattaatttaccataaatttggtccaaataactcacttaaacatgtatatattgataaatcgatagataaagaaacaggtaagaagaaaaaa

SEQ ID NO: 4894 - protein, 551 aa, Staphylococcus aureus
  MISC_FEATURE (1)..(551): hypothetical protein
MTRKFRTLILILIATIALSGCANDDGIYSDKGQVFRKILSSDLTSLDTSLITDEISSEVTAQTFEGLYTLGKGDKPVLGVAKAFPEKSKDGKTLKVKLRSDAKWSNGDKVTAQDFVYAWRKTVDPKTGSEFAYIMGDIKNASDISTGKKPVEQLGIKALNDETLQIELEKPVPYINQLLALNTFAPQNEKVAKKYGKNYGTAADRAVYNGPFKVDDWKQEDKTLLSKNQYYWDKKNVKLDKVNYKVIKDLQAGASLYDTESVDDAVITADQVNKYKDNKGLNFVLTTGTFFVKMNEKQYPDFKNKNLRLAIAQAIDKKGYVDSVKNNGSIPSDTLTAKGIAKAPNGKDYASTMNSPLKYNPKEARAHWDKAKKELGKNEVTFSMNTEDTPDAKISAEYIKSQVEKNLPGVTLKIKQLPFKQRVSLELSNNFEASLSGWSADYPDPMAYLETMTTGSAQNNTDWGNKEYDQLLKVARTKLALQPNERYENLKKAEEMFLGDAPVAPIYQKGVAHLTNPQVKGLIYHKFGPNNSLKHVYIDKSIDKETGKKKK

SEQ ID NO: 4895 - DNA, 939 bp, Staphylococcus aureus
atgaaaaatgatgaagtgctattatctattaaaaatttaaagcaatattttaacgcaggaaagaaaaacgaagtgagagcgattgaaaatatttcgtttgatatatacaaaggggaaacattaggtttagtaggagaatcggggtgtggtaaatctacaactggtaaatcaattattaaacttaatgatattacaagtggagaaattttgtatgagggtattgatatacaaaagattcgtaaacgtaaagatttgcttaaatttaataaaaagatacagatgatttttcaagacccatatgcgtctttaaatcctaggttaaaagtaatggatatagtagctgaaggtattgatatccatcatttagcaactgataagcgtgaccgaaaaaaacgtgtctatgatttacttgaaactgttggattaagtaaagaacatgccaatcgctatcctcatgaattttcaggtggacaacgccaacgtattggaattgcccgtgcattagccgttgaaccagaattcattatcgcggacgaaccaatatcggcattggatgtttcaatccaagctcaagtagttaatttattattaaaattacaacgtgaaagagggattacgttcctatttatagctcatgatctatcaatggtgaagtatatttcagatcgtattgcagtcatgcattttgggaaaatagttgaaattggaccggcagaagaaatttatcaaaatccattacacgattatactaagtctttattatcagccattccacaacctgatcctgaatcagaacgcagtcgcaaacgatttagttatattgatgatgaagcaaataatcatttaagacaattacatgaaattagaccgaatcactttgtctttagtactgaagaagaagcggcacaactacgagaaaataaattggtgacacaaaat

SEQ ID NO: 4896 - protein, 313 aa, Staphylococcus aureus
  MISC_FEATURE (1)..(313): oligopeptide transport
MKNDEVLLSIKNLKQYFNAGKKNEVRAIENISFDIYKGETLGLVGESGCGKSTTGKSIIKLNDITSGEILYEGIDIQKIRKRKDLLKFNKKIQMIFQDPYASLNPRLKVMDIVAEGIDIHHLATDKRDRKKRVYDLLETVGLSKEHANRYPHEFSGGQRQRIGIARALAVEPEFIIADEPISALDVSIQAQVVNLLLKLQRERGITFLFIAHDLSMVKYISDRIAVMHFGKIVEIGPAEEIYQNPLHDYTKSLLSAIPQPDPESERSRKRFSYIDDEANNHLRQLHEIRPNHFVFSTEEEAAQLRENKLVTQN

SEQ ID NO: 4897 - DNA, 1080 bp, Staphylococcus aureus
atgactgaaagaatattagaagtaaatgatttgcatgtttcctttgatattacagcaggggaagtgcaggcagtgagaggcgtagatttttatttgaacaaaggggaaacattggcaattgttggtgaatcaggttcaggtaaatctgtaacaacaaaagcaattacaaaattattccaaggggacacaggaagaattaaaaagggagaaattttatttttaggggaagatttagcaaaaaaacctgaaaatgagttgattaaattacgtggcaaagatatttcaatgatctttcaagatccaatgacatctttaaacccaacgatgcaaattggtaaacaagtcatggaaccattaattaagcacaaaaattatagtaaagcacaagctaaaaagcgcgcattggaaatactaaatcttgtaggtttaccaaatgcagaaaaaagatttaaagcatatcctcatcaattttcaggtggacaaaggcaaagaattgttattgcaaccgcattagcttgtgaacctaaagtgctcattgctgatgaaccaacgactgcattagacgtaacgatgcaggcacaaattttagatttaatgaaagaactacaacaaaaaatcgatacagcaattatttttataacgcatgatttaggggttgttgcgaatattgctgatagagtggcagttatgtatggtggtcaaatggttgaaacaggagatgttaacgaaatattttatgatccaaagcatccatatacatggggattattatcgtcaatgcctgatttatcaacaacaaatgacacaccattactagcgattcctggagcgccacctgatttattacacccacctaaaggtgatgcatttgcgagacgtagtcaatatgcattagatattgattttaaagtagaaccaccgtggtttaaagtttcaccgacacattttgtgaaatcttggttattagacgcacgtgcaccaaaagttgaactacccgagctggtaaaacaacgtatgaaaccgatgcctaataattatgaaaaaccactcaaggtagaaagggtgtcgttcaatgaaaaa

SEQ ID NO: 4898 - protein, 360 aa, Staphylococcus aureus
  MISC_FEATURE (1)..(360): oligopeptide transport
MTERILEVNDLHVSFDITAGEVQAVRGVDFYLNKGETLAIVGESGSGKSVTTKAITKLFQGDTGRIKKGEILFLGEDLAKKPENELIKLRGKDISMIFQDPMTSLNPTMQIGKQVMEPLIKHKNYSKAQAKKRALEILNLVGLPNAEKRFKAYPHQFSGGQRQRIVIATALACEPKVLIADEPTTALDVTMQAQILDLMKELQQKIDTAIIFITHDLGVVANIADRVAVMYGGQMVETGDVNEIFYDPKHPYTWGLLSSMPDLSTTNDTPLLAIPGAPPDLLHPPKGDAFARRSQYALDIDFKVEPPWFKVSPTHFVKSWLLDARAPKVELPELVKQRMKPMPNNYEKPLKVERVSFNEK

SEQ ID NO: 4899 - DNA, 1068 bp, Staphylococcus aureus
atggctgaaaataaaaacaatttgtcgattaacgacgatcattctaatgcagctatgacgcatacctctgacgctatcgcatcatctgattttattattagagaattagatttgaatcaggaacctgaaatgcaacgagaaagcaaaaacttttggcaagatgcttgggctcagttaaaacgaaataagttagctgttgtcggtatgataggtttaattatcattgtaatatttgcttttatcggtccagttataaataaacatgattatgctgaacaaaatgtagaacatagaaatcttccggcaaaaatacctgtattagacaaagttccatttttaccttttgatggtaaagatgcagatggcaaggatgcttataaagcagcaaatgctaaagaaaattattggtttggtactgatcagttgggtcgagatttatggacaagaacatggaaaggtgctcaaatttcattgtttatcggtgttgttgcagcgatgttagatatttttattggtgttgtatatggtgcgatttctggattcttcggtggacgtgtcgatacgattatgcaacgtatacttgaagtcatagcatctattccgaatttaattgtcgtaattttatttgtattaatttttgaaccatccatttggacaattatattggctatgtctatcacaggctggttaggcatgagcagagttgtacgtggagaatttttaaaattaaaaaatcaagagtttgtcatggcttcgaaaacattgggggcttcaaaattcaaattgatatttaagcatattttacctaatacattaggtgctatcgtggttacatcaatgtttacagtacctagtgctattttcttcgaagcatttttaagtttcattggtataggtgtacccgcacctcaaacatcgttagggtcattagtaaatgatgggcgcgcaatgttattaatttatccacatgaattatttataccagcaatgattttaagtttattaattctattcttttacttatttagtgatggattacgtgatgcatttgatccgaaaatgcgtaaa

SEQ ID NO: 4900 - protein, 356 aa, Staphylococcus aureus
  MISC_FEATURE (1)..(356): hypothetical protein
MAENKNNLSINDDHSNAAMTHTSDAIASSDFIIRELDLNQEPEMQRESKNFWQDAWAQLKRNKLAVVGMIGLIIIVIFAFIGPVINKHDYAEQNVEHRNLPAKIPVLDKVPFLPFDGKDADGKDAYKAANAKENYWFGTDQLGRDLWTRTWKGAQISLFIGVVAAMLDIFIGVVYGAISGFFGGRVDTIMQRILEVIASIPNLIVVILFVLIFEPSIWTIILAMSITGWLGMSRVVRGEFLKLKNQEFVMASKTLGASKFKLIFKHILPNTLGAIVVTSMFTVPSAIFFEAFLSFIGIGVPAPQTSLGSLVNDGRAMLLIYPHELFIPAMILSLLILFFYLFSDGLRDAFDPKMRK

SEQ ID NO: 4901 - DNA, 924 bp, Staphylococcus aureus
atggggaaatatattttcaaacgatttatttatatgcttatttctttatttattattattacaattacatttttcttaatgaaattaatgccaggttcgccatttaacgatgctaaattaaatgctgaacaaaaagaaattttaaatgaaaaatatggattaaatgatcctgtagctacgcagtatttacattatttaaaaaatgttgttacaggcgattttggtaattcattccagtatcataatcaacctgtgtgggatttgattaaaccgagactactaccttcttttgaaatgggtcttacagcaatgttcatcggtgtgatactgggacttattttaggtgttgcagcagctactaaacaaaattcttgggttgactatacaactacagttatttcagttattgcagtatctgtaccatcttttgtacttgctgtacttttacaatatgtatttgcagttaaattaagatggttcccagtagctggatgggaaggtttttcgaccgcggtattaccgtcacttgcattatctgcagctgttttagcaactgtcgccagatacataagagcagagatgatagaggtattaagttcagactatattttattagcgagagctaaaggtaattcgacaatgcgtgtactttttggacatgcacttagaaatgctttaattccaattattacaattatcgttcccatgttagcaagtattttaacaggcactttaacaattgaaaatatttttggagttcctggattaggggatcaattcgtacgttcaattacaacaaatgatttctcagtaatcatggcaatcacactattatttagcacactgtttatcgtttctatttttattgtagatattttgtacggtgtgatagatccacgaattcgtgttcaaggaggtaaaaaa

SEQ ID NO: 4902 - protein, 308 aa, Staphylococcus aureus
  MISC_FEATURE (1)..(308): oligopeptide transport
MGKYIFKRFIYMLISLFIIITITFFLMKLMPGSPFNDAKLNAEQKEILNEKYGLNDPVATQYLHYLKNVVTGDFGNSFQYHNQPVWDLIKPRLLPSFEMGLTAMFIGVILGLILGVAAATKQNSWVDYTTTVISVIAVSVPSFVLAVLLQYVFAVKLRWFPVAGWEGFSTAVLPSLALSAAVLATVARYIRAEMIEVLSSDYILLARAKGNSTMRVLFGHALRNALIPIITIIVPMLASILTGTLTIENIFGVPGLGDQFVRSITTNDFSVIMAITLLFSTLFIVSIFIVDILYGVIDPRIRVQGGKK

SEQ ID NO: 4903 - DNA, 369 bp, Staphylococcus aureus
atgttgaaaaaatggcttggaatggcactaataacgccaatattaacgtttattatatggctttttaatagccatactatcattacatatttaaatatattgttttatgtttcattaattatttttattagcatatttttgattttacttgtacaagaaggcatttttgatgcgacaagttatggttttagaagattaaagtatcaaatgtcatcttcgaaaaagaagaagtctatctctgatgatccatttttcaacccacaagaggtaaaaaaagagcattactttgtttctacatggataatccccttattattaataaatattttatattttattatgacgattgtgctgtcgctcatcttagta

SEQ ID NO: 4904 - protein, 123 aa, Staphylococcus aureus
  MISC_FEATURE (1)..(123): hypothetical protein
MLKKWLGMALITPILTFIIWLFNSHTIITYLNILFYVSLIIFISIFLILLVQEGIFDATSYGFRRLKYQMSSSKKKKSISDDPFFNPQEVKKEHYFVSTWIIPLLLINILYFIMTIVLSLILV

SEQ ID NO: 4905 - DNA, 1242 bp, Staphylococcus aureus
atgagtcaaaataaaagagtagttattacaggtatgggagccctttctccaatcggtaatgatgtcaaaacaacatgggagaatgctctaaaaggcgtaaatggtatcgataaaattacacgtatcgatactgaaccttatagcgttcacttagcaggagaacttaaaaactttaatattgaagatcatatcgacaaaaaagaagcgcgtcgtatggatagatttactcaatatgcaattgtagcagctagagaggctgttaaagatgcgcaattagatatcaatgaaaatactgcagatcgaatcggtgtatggattggttctggtatcggtggtatggaaacatttgaaattgcacataaacaattaatggataaaggcccaagacgtgtgagtccatttttcgtaccaatgttaattcctgatatggcaactgggcaagtatcaattgacttaggtgcaaaaggaccaaatggtgcaacagttacagcatgtgcaacaggtacaaattcaatcggagaagcatttaaaattgtgcaacgcggtgatgcagatgcaatgattactggtggtacagaagcaccaattactcatatggcaattgctggtttcagtgcaagtcgagcgctttctacaaatgatgacattgaaacagcatgtcgtccattccaagaaggtagagatggttttgttatgggtgaaggtgctggtattttagtaattgaatctttagaatcagcacaagctcgaggtgccaatatttatgctgagatagttggctatggtactacaggtgatgcttatcatattacagcgccagctccagaaggtgaaggtggttctagagcaatgcaagcagctatggatgatgctggtattgaacctaaagatgtacaatacttaaatgcccatggtacaagtactcctgttggtgacttaaatgaagttaaagctattaaaaatacatttggtgaagcagctaaacacttaaaagttagctcaacaaaatcaatgactggtcacttacttggtgcaacaggtggaattgaagcaatcttctcagcgctttcaattaaagactctaaagtcgcaccgacaattcatgcggtaacaccagatccagaatgtgatttggatattgttccaaatgaagcgcaagaccttgatattacttatgcaatgagtaatagcttaggattcggtggacataacgcagtattagtattcaagaaatttgaagca

SEQ ID NO: 4906 - protein, 414 aa, Staphylococcus aureus
  MISC_FEATURE (1)..(414): conserved hypothetical
MSQNKRVVITGMGALSPIGNDVKTTWENALKGVNGIDKITRIDTEPYSVHLAGELKNFNIEDHIDKKEARRMDRFTQYAIVAAREAVKDAQLDINENTADRIGVWIGSGIGGMETFEIAHKQLMDKGPRRVSPFFVPMLIPDMATGQVSIDLGAKGPNGATVTACATGTNSIGEAFKIVQRGDADAMITGGTEAPITHMAIAGFSASRALSTNDDIETACRPFQEGRDGFVMGEGAGILVIESLESAQARGANIYAEIVGYGTTGDAYHITAPAPEGEGGSRAMQAAMDDAGIEPKDVQYLNAHGTSTPVGDLNEVKAIKNTFGEAAKHLKVSSTKSMTGHLLGATGGIEAIFSALSIKDSKVAPTIHAVTPDPECDLDIVPNEAQDLDITYAMSNSLGFGGHNAVLVFKKFEA

SEQ ID NO: 4907 - DNA, 939 bp, Staphylococcus aureus
atgaacgtgggtattaaaggttttggtgcatatgcgccagaaaagattattgacaatgcctattttgagcaatttttagatacatctgatgaatggatttctaagatgactggaattaaagaaagacattgggcagatgatgatcaagatacttcagatttagcatatgaagcaagtttaaaagcaatcgctgacgctggtattcagcccgaagatatagatatgataattgttgccacagcaactggagatatgccatttccaactgtcgcaaatatgttgcaagaacgtttagggacgggcaaagttgcctctatggatcaacttgcagcatgttctggatttatgtattcaatgattacagctaaacaatatgttcaatctggagattatcataacattttagttgtcggtgcagataaattatctaaaataacagatttaactgaccgttctactgcagttctatttggagatggtgcaggtgcggttatcatcggtgaagtttcagatggcagaggtattataagttatgaaatgggttctgatggcacaggtggtaaacatttatatttagataaagatactggtaaactgaaaatgaatggtcgagaagtatttaaatttgctgttagaattatgggtgatgcatcaacacgtgtagttgaaaaagcgaatttaacatcagatgatatagatttatttattcctcatcaagctaatattagaattatggaatcagctagagaacgcttaggtatttcaaaagacaaaatgagtgtttctgtaaataaatatggaaatacttcagctgcgtcaatacctttaagtatcgatcaagaattaaaaaatggtaaaatcaaagatgatgatacaattgttcttgtcggattcggtggcggcctaacttggggcgcaatgacaataaaatggggaaaa

SEQ ID NO: 4908 - protein, 313 aa, Staphylococcus aureus
  MISC_FEATURE (1)..(313): 3-oxoacyl-(acyl-carrier
MNVGIKGFGAYAPEKIIDNAYFEQFLDTSDEWISKMTGIKERHWADDDQDTSDLAYEASLKAIADAGIQPEDIDMIIVATATGDMPFPTVANMLQERLGTGKVASMDQLAACSGFMYSMITAKQYVQSGDYHNILVVGADKLSKITDLTDRSTAVLFGDGAGAVIIGEVSDGRGIISYEMGSDGTGGKHLYLDKDTGKLKMNGREVFKFAVRIMGDASTRVVEKANLTSDDIDLFIPHQANIRIMESARERLGISKDKMSVSVNKYGNTSAASIPLSIDQELKNGKIKDDDTIVLVGFGGGLTWGAMTIKWGK

SEQ ID NO: 4909 - DNA, 183 bp, Staphylococcus aureus
atgaaacacctcgtaacattcttttgggcattattattaatgcaaatggttaactttgtacttaatagcctagtaggtggagacagcttaaatgtagtgaatccaattatcatggcagtattgttcacgattttcacagcaatttttgctgcagtaattaaaccgccgaaagattcatcacaa

SEQ ID NO: 4910 - protein, 61 aa, Staphylococcus aureus
  MISC_FEATURE (1)..(61): hypothetical protein
MKHLVTFFWALLLMQMVNFVLNSLVGGDSLNVVNPIIMAVLFTIFTAIFAAVIKPPKDSSQ

SEQ ID NO: 4911 - DNA, 432 bp, Staphylococcus aureus
atgaaattaaaatcatttataactgtaactttggcactgggcatgatcgcaacgactggcgctactgtggcaggtaatgaggtatctgcagcagaaaaggacaaactaccggcaactcaaaaagctaaagaaatgcaaaatgttccatatacaattgcagtagatggcattatggctttcaatcaatcttacttaaatttaccaaaagatagccaattatcatatttagatttaggaaataaagttaaagctttgttatatgatgaacgcggtgtaacacctgagaagattcgaaatgcaaaatctgccgtttacacgattacttggaaagatggtagtaaaaaagaagtggatcttaagaaagatagctacacagcaaacttgtttgattcaaattcaattaaacaaattgatattaatgtaaaaactaaa

SEQ ID NO: 4912 - protein, 144 aa, Staphylococcus aureus
  MISC_FEATURE (1)..(144): hypothetical protein
MKLKSFITVTLALGMIATTGATVAGNEVSAAEKDKLPATQKAKEMQNVPYTIAVDGIMAFNQSYLNLPKDSQLSYLDLGNKVKALLYDERGVTPEKIRNAKSAVYTITWKDGSKKEVDLKKDSYTANLFDSNSIKQIDINVKTK

SEQ ID NO: 4913 - DNA, 933 bp, Staphylococcus aureus
gtgaatcaaatgagtaaaacagcaattatttttccgggacaaggtgcccaaaaagttggtatggcgcaagatttgtttaacaacaatgatcaagcaactgaaattttaacttcagcagcgaacacattagactttgatattttagagacaatgtttactgatgaagaaggtaaattgggtgaaactgaaaacacacaaccagctttattgacgcatagttcggcattattagcagcgctaaaaaatttgaatcctgattttactatggggcatagtttaggtgaatattcaagtttagttgcagctgacgtattatcatttgaagatgcagttaaaattgttagaaaacgtggtcaattaatggcgcaagcatttcctactggtgtaggaagcatggctgcagtattgggattagattttgataaagtcgatgaaatttgtaagtcattatcatctgatgacaaaataattgaaccagcaaacattaattgcccaggtcaaattgttgtttcaggtcacaaagctttaattgatgagctagtagaaaaaggtaaatcattaggtgcaaaacgtgtcatgcctttagcagtatctggaccattccattcatcgctaatgaaagtgattgaagaagatttttcaagttacattaatcaatttgaatggcgtgatgctaagtttcctgtagttcaaaatgtaaatgcgcaaggtgaaactgacaaagaagtaattaaatctaatatggtcaagcaattatattcaccagtacaattcattaactcaacagaatggctaatagaccaaggtgttgatcattttattgaaattggtcctggaaaagttttatctggcttaattaaaaaaataaatagagatgttaagttaacatcaattcaaactttagaagatgtgaaaggatggaatgaaaatgac

SEQ ID NO: 4914 - protein, 311 aa, Staphylococcus aureus
  MISC_FEATURE (1)..(311): malonyl CoA-acyl carrier
VNQMSKTAIIFPGQGAQKVGMAQDLFNNNDQATEILTSAANTLDFDILETMFTDEEGKLGETENTQPALLTHSSALLAALKNLNPDFTMGHSLGEYSSLVAADVLSFEDAVKIVRKRGQLMAQAFPTGVGSMAAVLGLDFDKVDEICKSLSSDDKIIEPANINCPGQIVVSGHKALIDELVEKGKSLGAKRVMPLAVSGPFHSSLMKVIEEDFSSYINQFEWRDAKFPVVQNVNAQGETDKEVIKSNMVKQLYSPVQFINSTEWLIDQGVDHFIEIGPGKVLSGLIKKINRDVKLTSIQTLEDVKGWNEND

SEQ ID NO: 4915 - DNA, 513 bp, Staphylococcus aureus
atgaaaataaaaactgaatttaaagggaacaatataccatatgaatacgcagcaggtgcagatgtgagtgattctattaacgggaatccaattaagtcatttccatttgaagtaattgaattaccggaagggactaaatatcttgcttggtctttaattgactatgatgcaattcctgtatgtggctttgcttggattcattggagtgtagctaatgtaagtgttagtggcaattcaatttctataaaagcagatttatcaagaacaaagggcgactatgtacaaggtaaaaatagctttactagtgggttgttggctgaagatttttcagaaatagaaaatcactatgtaggacctacaccacctgatcaagatcatcaatatgaattaacagtttatgcgttagatcattctttaaatttgaagaatgggttctacttgaatgaatttttaaaagaagtaaatcaacataaaattgatcaaacaagtattaaccttataggaagaaaaatt

SEQ ID NO: 4916 - protein, 171 aa, Staphylococcus aureus
  MISC_FEATURE (1)..(171): conserved hypothetical
MKIKTEFKGNNIPYEYAAGADVSDSINGNPIKSFPFEVIELPEGTKYLAWSLIDYDAIPVCGFAWIHWSVANVSVSGNSISIKADLSRTKGDYVQGKNSFTSGLLAEDFSEIENHYVGPTPPDQDHQYELTVYALDHSLNLKNGFYLNEFLKEVNQHKIDQTSINLIGRKI

SEQ ID NO: 4917 - DNA, 1116 bp, Staphylococcus aureus
atgaataagttaatacttgggatttatttataccgaattttttcacgagcatacttttatttaccgtttttattaatttactttttgattcaaggttattccataatacaattagaaatattaatggcgtcttatggcattgcagcatttttattctctctatacaaagagaagtgttttaaaatttgtaacttaaaagattctaataaattagttgttagtgaaatattcaaaatcatcggtttattgttgttattatatcaaaatcaatatttaattttagtagtggcacaaatattattagggttaagttactcaatgatggcgggtgttgataccgcaataattaaaagaaatataacaaatgagaaatacgtacaaaataagtcaaatagctatatgttcctatcattattaatttcagggattataggtagttatctttatggaataaatattaaatggcctataataatgactggtatattttcaattctaacaattataattattcgatgcacattagttgaaaatagggaattaaatttaataggagaaacaaagggaaagataaagaaatttctaccagaagagaagttttggatattgcattattcttttttaagagcgttaatattaggattttttataggatttattccaattaatatatataatgatttaaaactgaataatttacaatttatttcagtattaacttgttacacagttatgggttttgtatcttcacgttatttaactaaatacttgaattataagtttgtgtcagaaatttgtttagtaatatttttaataatatatacatatcaaagtttcatagcagttactatttctatgatatttttaggtatttcttcagggttaactcgtccacaaactataaataaactttctagcagtagtaacttaagagtgatgcttaattatgcagaaacgttatattttatttttaatatcgcatttttacttatgggtggttacttatatacaataggaactattcaatacttaatattatttatttcgttattaatttttatatatttaataataatattttattttacaaggagagagcaacatgaaaataaaaac

SEQ ID NO: 4918 - protein, 372 aa, Staphylococcus aureus
  MISC_FEATURE (1)..(372): hypothetical protein
MNKLILGIYLYRIFSRAYFYLPFLLIYFLIQGYSIIQLEILMASYGIAAFLFSLYKEKCFKICNLKDSNKLVVSEIFKIIGLLLLLYQNQYLILVVAQILLGLSYSMMAGVDTAIIKRNITNEKYVQNKSNSYMFLSLLISGIIGSYLYGINIKWPIIMTGIFSILTIIIIRCTLVENRELNLIGETKGKIKKFLPEEKFWILHYSFLRALILGFFIGFIPINIYNDLKLNNLQFISVLTCYTVMGFVSSRYLTKYLNYKFVSEICLVIFLIIYTYQSFIAVTISMIFLGISSGLTRPQTINKLSSSSNLRVMLNYAETLYFIFNIAFLLMGGYLYTIGTIQYLILFISLLIFIYLIIIFYFTRREQHENKN

SEQ ID NO: 4919 - DNA, 639 bp, Staphylococcus aureus
atggaaattttaaatgattctgtaaaaagttttgaaaaactttatttacaattacaagatggttttccagtgattgttcctactgatactaattataatttatgtagtttacctaacaacgatctttgtatcgataaaatatttgaatataaaaagcgatcgaaagataagccattatcattatttattgataagccagaggattggaaattgtatggagataatcaaaatacggaaatagttgataaactagttgaaatattttggcctggaccattaaatattattttaaaaaataaaacaagctataattatatgctcaataattcagatagtatagctataggatgtgtacaaaataaaacgatgagaagatttatttcatatattaattcacctatagcaattacttcagcaaatatatctggaactgccgatgatattttaataactgaaaatgaagcaattaagcacatgggcgaaaatgtaagatatatgctaagaagtcaaaataaaactaactataaaacatctagtacgattattaaagtgacagataataaaattgaattattaagagaaggagatataaagtttgaagaaataaaagaaagactaggtacaggtattatttatgaa

SEQ ID NO: 4920 - protein, 213 aa, Staphylococcus aureus
  MISC_FEATURE (1)..(213): conserved hypothetical
MEILNDSVKSFEKLYLQLQDGFPVIVPTDTNYNLCSLPNNDLCIDKIFEYKKRSKDKPLSLFIDKPEDWKLYGDNQNTEIVDKLVEIFWPGPLNIILKNKTSYNYMLNNSDSIAIGCVQNKTMRRFISYINSPIAITSANISGTADDILITENEAIKHMGENVRYMLRSQNKTNYKTSSTIIKVTDNKIELLREGDIKFEEIKERLGTGIIYE

SEQ ID NO: 4921 - DNA, 1143 bp, Staphylococcus aureus
atgattcgaattcaagataatacaataagggatggtatgcaacaaagtaatgttcgaaaaagtctaattataaaaaaagaagtattgaaacaaattaacaagttaaatataaattctgttgaagtaggcatgtgtacaactatcgaggatgaatttaatattcatcaattcagagacattttaagtcctgaaaaagaattagtagtattgactaggcttaatgaaaaagaaataaaaaaaatagtcaaattgaaaattcataatttagtggtaaaaatactattgccaatatctgacttgcatataaaagaaaagcttaatttttcaaataaatattatattcagaaaatcaaagactgcttggatatattaaagaaagataaaaaaggagtagatatttgttttgaagatggaacaaggacttctagagaaaaattgaaagaatacatggaaattatttcaaaatatcaagttagaacagttacatttgcggacactgtaggatgttcgacaccattagaatacggagatatttttaattactttgtaaaaaaatattctaacataattttttctgctcattgtcataacgatctagggttggctactgcaaatacattagctgcaattttaaatggtgcaaagcaaatagaaactacatttttgggaattggtgagagagcgggtaatgctcctattgaggaaataattactattttgacaaaaaaacaaatagaaagtacggaattcactttacccgacgtatataaaactagtattaatatttctaaaattctcgattttcaaatatcagaaaacaaacctataattggtgaaaatatatttaaacatgaatcaggaattcatcaagatggtactaaaaaaaatataaatatgtatcaatatttagttcctagtgatttaggattgaaaaattcacaagttgttcagtttccaataagtaatatttctagtaagaaaatcttgcacaataaatttaaatcaatagttaacactgaagaaattgatgaaaatatttctttctataaacttgtgaacaagttttcacctgaagtagcacctgaagatacagtggatttacttcagataataaaaaggaggagtaaagatggaaattttaaa

SEQ ID NO: 4922 - protein, 381 aa, Staphylococcus aureus
  MISC_FEATURE (1)..(381): hypothetical protein
MIRIQDNTIRDGMQQSNVRKSLIIKKEVLKQINKLNINSVEVGMCTTIEDEFNIHQFRDILSPEKELVVLTRLNEKEIKKIVKLKIHNLVVKILLPISDLHIKEKLNFSNKYYIQKIKDCLDILKKDKKGVDICFEDGTRTSREKLKEYMEIISKYQVRTVTFADTVGCSTPLEYGDIFNYFVKKYSNIIFSAHCHNDLGLATANTLAAILNGAKQIETTFLGIGERAGNAPIEEIITILTKKQIESTEFTLPDVYKTSINISKILDFQISENKPIIGENIFKHESGIHQDGTKKNINMYQYLVPSDLGLKNSQVVQFPISNISSKKILHNKFKSIVNTEEIDENISFYKLVNKFSPEVAPEDTVDLLQIIKRRSKDGNFK

SEQ ID NO: 4923 - DNA, 867 bp, Staphylococcus aureus
atgaatttagattggtactatacatttgtcattttagcgaagacgttaaactatcgattagctagtgaagaaattaatctcactataccttctatacataagcaaattaaaaatttagaacagcatctcaatgtgaaactatttgaaacttataaaaatcaaattatcttgactgaagatggtcatacatttcttccaattgcgcaaagttttattgaacaatatgaaagtggcatcaaacatatccaacttaaaaaaacgatgtttcaatcgaaattaaatgttgtcgtgtcttcatatatcgcgacattcattatgcccaaatttttaaaatctttctttaacgagcatccttttatcgatgtttctcttcatgtcaaaaatgaaaatattgaaaaagatattaataatcatacgtatgacatcgggattagcagaaatcaacctaaactaagagaagttcattctgaaaaagtatgcgaaggtaaaattgtattgattgctcccaataaagagaataatcatcttctaactgaggcatctttatttgaaaaatacaaaataataagtgataaccatccagaatattggtcatcacttaaaaataatattttaaatatttatgaaaaagcacaatttctatctatcaatgatgtgcatacttcaattaaattaatcgaaatgaatcaaggtatatcattcctgcctctttatataacaacaaatagtgattacaatatttcggttattaacacgaaaattttacaagcacctatttcatttacatatatatacagcaaaaaagaaagcccagaaatattggtgtttattaaatcatttaaaaagtatattgccaatgaacaatta

SEQ ID NO: 4924 - protein, 289 aa, Staphylococcus aureus
  MISC_FEATURE (1)..(289): hypothetical protein
MNLDWYYTFVILAKTLNYRLASEEINLTIPSIHKQIKNLEQHLNVKLFETYKNQIILTEDGHTFLPIAQSFIEQYESGIKHIQLKKTMFQSKLNVVVSSYIATFIMPKFLKSFFNEHPFIDVSLHVKNENIEKDINNHTYDIGISRNQPKLREVHSEKVCEGKIVLIAPNKENNHLLTEASLFEKYKIISDNHPEYWSSLKNNILNIYEKAQFLSINDVHTSIKLIEMNQGISFLPLYITTNSDYNISVINTKILQAPISFTYIYSKKESPEILVFIKSFKKYIANEQL

SEQ ID NO: 4925 - DNA, 2607 bp, Staphylococcus aureus
atggatataaataaaatgacatatgctgttcaaagtgctttacaacaagcagttgaactgagtcagcaacataaattacaaaatatagaaattgaggcaattttaagcgctgccttaaatgaaagtgaaagcttatataaaagtattttagaacgagtaaatattgaggtagatcaattaaacaaagcttatgaagacaaactaaacacgtatgcatctgtagaaggtgacaatatacaatatggtcaatatattagccaacaagcaaaccaattgataactaaggctgaatcatacatgaaagaatatgaagatgaatatatttcaatggagcatattttacgttcggcaatggacattgatcaaacaacaaaacattatataaataataaagtagaagttatcaaagaaattattaaaaaagtaagagggggaaatcacgtgacatcacaaaatccagaagttaattacgaagcattagctaaatatggccgcgacttagtagaagaagttagacaaggtaaaatggatcctgttataggaagagatgaagaaattcgaaatacgattcgtattttaagtcgtaaaactaaaaacaaccctgtgctcattggtgaaccaggtgttggtaaaactgcaattgttgaaggattagcgcaacgtatagttaagaaagatgtgccagaatcattattagataaaactgtttttgagttagatttaagcgcattagtagcgggcgctaaatatcgtggtgaatttgaagagagattaaaagcagtcctaaaagaagttaaagagtctgatggtagaattatattatttattgatgaaatccatatgcttgtaggtgctggtaaaacagatggtgccatggatgcaggcaacatgctaaaaccaatgttagcacgaggagagttacattgtattggtgcaacaactttaaatgaatatcgagaatatattgaaaaagattcggcattagagcgtcgtttccaaaaagtagcagttagtgagcctgatgttgaagatacaatttcaattttacgtggtttaaaagaacgatatgaagtgtatcatggtgtgcgtattcaagatagagccttagttgctgccgctgaattgtctgatcgttacatcactgatcgttttttaccagataaagcgattgatttagttgaccaagcatgtgcaacaattcgtacggaaatgggatcaaatccaactgaattggatcaagttaatagacgtgtcatgcaattagaaattgaagaaagcgcacttaaaaatgaatctgacaatgcgagcaaacagagattacaagaactacaagaagagcttgccaatgaaaaagagaaacaagcagcacttcaatctcgtgtagaatcagaaaaagaaaaaatagcaaatttacaagaaaaacgtgcgcaactagatgaaagtagacaagcgttggaagatgcacaaacaaataacaatttagaaaaagctgctgaactacaatatggaacaattcctcaattggaaaaagaacttagagaattagaggataatttccaagatgagcaaggtgaagatacagatcgaatgattcgtgaagttgtaacagacgaagaaattggcgatattgtcagccaatggacaggcataccagtttcaaaattagttgaaacagaacgtgaaaaattacttcacttaagtgacatcttgcataaacgtgttgtaggtcaagataaagcggttgacctggtttcagatgcagtagttagagcaagagcaggtattaaagatccaaacagacctattggtagtttcttattcctaggtccaactggagtaggtaaaactgaattagctaaatcattagctgcatcattatttgattctgaaaaacatatgattcgtattgatatgagtgaatatatggaaaaacatgcagtatcaagattgataggggcacctccaggatatattggacatgatgaagggggtcaattaactgaagcggttcgtcgtaatccatactcagttattttattagatgaggttgaaaaagcgcatactgacgtctttaatgtattattgcaaattttagatgaaggccgtttaactgattctaaaggacgtagcgttgattttaaaaatactattattattatgacaagtaatattggatctcaagttttattagaaaacgtaaaagagactggtgaaattacagaatcaacagaaaaagctgttatgacaagtttaaatgcatatttcaaaccagaaattttgaatcgtatggatgatatcgtattatttaaaccattatctattgatgacatgagtatgattgtagataaaatcttaacgcaattaaatataagattattagaacaacgaatctcaattgaagtttctgatgatgctaaagcttggctaggtcaagaagcttatgaacctcaatacggtgcaagaccattaaaacgttttgtacaacgccaaattgaaacaccattagcacgtatgatgattaaagagggattcccagaaggtacaacgattaaagttaatttaaattcagacaataacttaacgtttaatgttgaaaaaattcatgaa

SEQ ID NO: 4926 - protein, 869 aa, Staphylococcus aureus
  MISC_FEATURE (1)..(869): ClpB chaperone homologue
MDINKMTYAVQSALQQAVELSQQHKLQNIEIEAILSAALNESESLYKSILERVNIEVDQLNKAYEDKLNTYASVEGDNIQYGQYISQQANQLITKAESYMKEYEDEYISMEHILRSAMDIDQTTKHYINNKVEVIKEIIKKVRGGNHVTSQNPEVNYEALAKYGRDLVEEVRQGKMDPVIGRDEEIRNTIRILSRKTKNNPVLIGEPGVGKTAIVEGLAQRIVKKDVPESLLDKTVFELDLSALVAGAKYRGEFEERLKAVLKEVKESDGRIILFIDEIHMLVGAGKTDGAMDAGNMLKPMLARGELHCIGATTLNEYREYIEKDSALERRFQKVAVSEPDVEDTISILRGLKERYEVYHGVRIQDRALVAAAELSDRYITDRFLPDKAIDLVDQACATIRTEMGSNPTELDQVNRRVMQLEIEESALKNESDNASKQRLQELQEELANEKEKQAALQSRVESEKEKIANLQEKRAQLDESRQALEDAQTNNNLEKAAELQYGTIPQLEKELRELEDNFQDEQGEDTDRMIREVVTDEEIGDIVSQWTGIPVSKLVETEREKLLHLSDILHKRVVGQDKAVDLVSDAVVRARAGIKDPNRPIGSFLFLGPTGVGKTELAKSLAASLFDSEKHMIRIDMSEYMEKHAVSRLIGAPPGYIGHDEGGQLTEAVRRNPYSVILLDEVEKAHTDVFNVLLQILDEGRLTDSKGRSVDFKNTIIIMTSNIGSQVLLENVKETGEITESTEKAVMTSLNAYFKPEILNRMDDIVLFKPLSIDDMSMIVDKILTQLNIRLLEQRISIEVSDDAKAWLGQEAYEPQYGARPLKRFVQRQIETPLARMMIKEGFPEGTTIKVNLNSDNNLTFNVEKIHE

SEQ ID NO: 4927 - DNA, 1812 bp, Staphylococcus aureus
atgaacaaaacaaagggttttacaaagtataagaaaatgagatatattccagggctcgatggtttgagggcaatcgctgttctaggaattattatttaccacttaaataagcaatggttgacaggtggctttttaggtgtggatacattttttgtgatctctggttatttaattacaagcttattactcaaagagtatgatgacacaggtatcattaaattgaaaagcttttggatacgtcgtttaaaacgtttattaccagcagtcatagttttattaatggttgtagggacagcaaccttattattaaaatcagataatatcattagggttaaacatgatattattgctgcgatattttatgtatcaaactggtggtatatagcaaaagatgttaattattttgagcaattttcatttatgccattaaagcatttatggtctttagcaattgaagaacagttttacatatttttcccagttattttggttacattattgttaacaattaaaaagcgatacaaaataggatttattttttggggagtatcaataatttctttagggttaatgatgtttatctatagtattaatggggatcattcacgagtgtattttggtacagatactagattacagacattgttactgggtgttattttagcttttttatggccaccgtttaaattgaaaaatgatccacctaaagttgtaaaatatgttattgatagcataggtagtttatcatttatagtacttatattattatttttcattattaatgatgagacgaattggatatatgatggtggtttctatttaatatccatattaacgttatttattattgctagtgtcgttcatccatctacatggatagcgaagatattttcaaatccagtgttagtatttatcgggaaaaggtcttatagtttatatttatggcattttgcagtaattagtttcgtacatagttactatgtagacggacagatacctgtatatgtgtactttatagatataagtttaacaattatatttgcagagctatcatatcgctttatagaaactccatttagaaaagaaggtattaaagctttaaattggcgaccttcttatataccacaatttataagaatggcaattgtagtaaccttgttaattccatttatgttgattttagtaggtgcattcaataaatatggtaaagacattattggagaaaaagcgaatagctttgataccacaattgaagataattatttaatgcggatagcaccaattgataacatacacattgatggcttagtaagtgagaagaaaaaggaatcttccgacgtatataataatattaaacctcttttaatcggtgattcagtaatggttgatatcggtgagtcatttaagtcatcagttcctaagtctagaattgatggaaaagtagggcgtcaattgtatcaaaccttacctttagttaaagcgaattattcacaatataaaaaatcatctgatcaagtcgtattagaattaggtacaaatggcgactttactgtcaaacagctcgacgatttacttaatcaatttggaaaagccaagatttatttagttaatacacgtgttccaagaatttatgaggcaaatgtaaatcgattattagctgacgcggcgaaacgaaagtccaatgtcacattaattgattggtataagcgatcacaaggacatagtgaatattttgcaccagacggtgtacatttagagtacaaaggagtcctagctttaaaagatgaaatattaaaagcacttaaaaagaaa

SEQ ID NO: 4928 - protein, 604 aa, Staphylococcus aureus
  MISC_FEATURE (1)..(604): hypothetical protein
MNKTKGFTKYKKMRYIPGLDGLRAIAVLGIIIYHLNKQWLTGGFLGVDTFFVISGYLITSLLLKEYDDTGIIKLKSFWIRRLKRLLPAVIVLLMVVGTATLLLKSDNIIRVKHDIIAAIFYVSNWWYIAKDVNYFEQFSFMPLKHLWSLAIEEQFYIFFPVILVTLLLTIKKRYKIGFIFWGVSIISLGLMMFIYSINGDHSRVYFGTDTRLQTLLLGVILAFLWPPFKLKNDPPKVVKYVIDSIGSLSFIVLILLFFIINDETNWIYDGGFYLISILTLFIIASVVHPSTWIAKIFSNPVLVFIGKRSYSLYLWHFAVISFVHSYYVDGQIPVYVYFIDISLTIIFAELSYRFIETPFRKEGIKALNWRPSYIPQFIRMAIVVTLLIPFMLILVGAFNKYGKDIIGEKANSFDTTIEDNYLMRIAPIDNIHIDGLVSEKKKESSDVYNNIKPLLIGDSVMVDIGESFKSSVPKSRIDGKVGRQLYQTLPLVKANYSQYKKSSDQVVLELGTNGDFTVKQLDDLLNQFGKAKIYLVNTRVPRIYEANVNRLLADAAKRKSNVTLIDWYKRSQGHSEYFAPDGVHLEYKGVLALKDEILKALKKK

SEQ ID NO: 4929 - DNA, 315 bp, Staphylococcus aureus
gtgatatggatggaagaggcattgaaagatagtatcttaggtgcattagaaatggtaattgaccctgaattaggaattgatatcgttaatttgggtttagtatacaaagtgaatgttgatgatgaaggcgtatgtacagttgatatgactttaacatcaatgggatgtccaatgggacctcaaattattgatcaagttaaaacagtattagcagagattcctgaaattcaggatactgaagtgaatatcgtatggagtccaccttggacaaaagatatgatgtcacgttacgctaagattgcacttggtgtgagc

SEQ ID NO: 4930 - protein, 105 aa, Staphylococcus aureus
  MISC_FEATURE (1)..(105): conserved hypothetical
VIWMEEALKDSILGALEMVIDPELGIDIVNLGLVYKVNVDDEGVCTVDMTLTSMGCPMGPQIIDQVKTVLAEIPEIQDTEVNIVWSPPWTKDMMSRYAKIALGVS

SEQ ID NO: 4931 - DNA, 822 bp, Staphylococcus aureus
atgcaaccacatttaatatgtctagacttagacggaacattattaaacgataacaaagaaatttcatcatatactaaacaagtattaaatgaattacaacaacgtggacaccaaattatgattgcgactggcagaccttatcgtgcaagtcaaatgtattatcatgaattaaatttaacgacaccaattgttaattttaatggcgcttacgtacatcaccctaaagataaaaacttcaaaacttgccatgaaattttagatttaggcatcgcacaaaacattattcaaggattacaacaatatcaagtatcgaatattatagcagaagtgaaagattatgttttcattaacaatcatgatccaagattatttgaaggtttttcaatgggtaatccaagaattcaaactggtaatttacttgtccacttgaaagaatcccctacctcaattttaattgaagccgaagaaagtaaaatacctgaaatcaaaaatatgcttactcatttttatgccgatcatattgagcatcgacgctggggcgcaccattccctgtcattgaaattgtaaaacttggtattaataaagcaagaggcattgagcaagttagacaatttttaaatattgaccgaaataatattattgcattcggtgatgaagataatgatattgaaatgattgagtacgcgcgtcacggtgttgctatggaaaatggtttgcaagaacttaaagatgtagcgaacaatattacattcaacaataatgaagatggcattggtcgatatttgaatgatttctttaatttaaatattagatattactgt

SEQ ID NO: 4932 - protein, 274 aa, Staphylococcus aureus
  MISC_FEATURE (1)..(274): conserved hypothetical
MQPHLICLDLDGTLLNDNKEISSYTKQVLNELQQRGHQIMIATGRPYRASQMYYHELNLTTPIVNFNGAYVHHPKDKNFKTCHEILDLGIAQNIIQGLQQYQVSNIIAEVKDYVFINNHDPRLFEGFSMGNPRIQTGNLLVHLKESPTSILIEAEESKIPEIKNMLTHFYADHIEHRRWGAPFPVIEIVKLGINKARGIEQVRQFLNIDRNNIIAFGDEDNDIEMIEYARHGVAMENGLQELKDVANNITFNNNEDGIGRYLNDFFNLNIRYYC

SEQ ID NO: 4933 - DNA, 1314 bp, Staphylococcus aureus
atgcccaaaatagtcgtagtcggagcagtcgctggcggtgcaacatgtgccagccaaattcgacgtttagataaagaaagtgacattattatttttgaaaaagatcgtgatatgagctttgctaattgtgcattgccttatgtcattggcgaagttgttgaagatagaagatatgctttagcgtatacacctgaaaaattttatgatagaaagcaaattacagtaaaaacttatcatgaagttattgcaatcaatgatgaaagacaaactgtatctgtattaaatagaaagacaaacgaacaatttgaagaatcttacgataaactcattttaagccctggtgcaagtgcaaatagccttggctttgaaagtgatattacatttacacttagaaatttagaagacactgatgctatcgatcaattcatcaaagcaaatcaagttgataaagtattggttgtaggtgcaggttatgtttcattagaagttcttgaaaatctttatgaacgtggtttacaccctactttaattcatcgatctgataagataaataaattaatggatgccgacatgaatcaacctatacttgatgaattagataagcgggagattccataccgtttaaatgaggaaattaatgctatcaatggaaatgaaattacatttaaatcaggaaaagttgaacattacgatatgattattgaaggtgtcggtactcaccccaattcaaaatttatcgaaagttcaaatatcaaacttgatcgaaaaggtttcataccggtaaacgataaatttgaaacaaatgttccaaacatttatgcaataggcgatattgcaacatcacattatcgacatgtcgatctaccggctagtgttcctttagcttggggcgctcaccgtgcagcaagtattgttgccgaacaaattgctggaaatgacactattgaattcaaaggcttcttaggcaacaatattgtgaagttctttgattatacatttgcgagtgtcggcgttaaaccaaacgaactaaagcaatttgactataaaatggtagaagtcactcaaggtgcacacgcgaattattacccaggaaattcccctttacacttaagagtatattatgacacttcaaaccgtcagattttaagagcagctgcagtaggaaaagaaggtgcagataaacgtattgatgtactatcgatggcaatgatgaaccagctaactgtagatgagttaactgagtttgaagtggcttatgcaccaccatatagccaccctaaagatttaatcaatatgattggttacaaagctaaa

SEQ ID NO: 4934 - protein, 438 aa, Staphylococcus aureus
  MISC_FEATURE (1)..(438): coenzyme A disulfide
MPKIVVVGAVAGGATCASQIRRLDKESDIIIFEKDRDMSFANCALPYVIGEVVEDRRYALAYTPEKFYDRKQITVKTYHEVIAINDERQTVSVLNRKTNEQFEESYDKLILSPGASANSLGFESDITFTLRNLEDTDAIDQFIKANQVDKVLVVGAGYVSLEVLENLYERGLHPTLIHRSDKINKLMDADMNQPILDELDKREIPYRLNEEINAINGNEITFKSGKVEHYDMIIEGVGTHPNSKFIESSNIKLDRKGFIPVNDKFETNVPNIYAIGDIATSHYRHVDLPASVPLAWGAHRAASIVAEQIAGNDTIEFKGFLGNNIVKFFDYTFASVGVKPNELKQFDYKMVEVTQGAHANYYPGNSPLHLRVYYDTSNRQILRAAAVGKEGADKRIDVLSMAMMNQLTVDELTEFEVAYAPPYSHPKDLINMIGYKAK

SEQ ID NO: 4935 - DNA, 1005 bp, Staphylococcus aureus
atgataagcgaggataaaattatggttaaattagcaattgatatgatgggtggcgacaatgcgcctgatatcgtattagaagccgtacaaaaggctgttgaagactttaaagatctagaaattatacttttcggtgacgaaaaaaagtataatctgaaccatgaacgaatcgaatttagacattgttctgaaaagattgaaatggaagatgagcctgttagagcgattaaacgtaaaaaagatagctcaatggtaaaaatggctgaagctgtgaaatctggtgaagcagatggatgtgtgtcagcaggtaatactggtgctttaatgtcagctggtttattcattgttggacgtattaaaggtgtagctagaccggctttagtagtaacattgccaacgattgatggaaaaggttttgtctttttagacgttggtgcaaatgctgatgctaaacctgaacacttattacagtatgcgcaactaggggatatttatgctcaaaaaattagaggtattgataatccgaaaatctcattattaaatataggaaccgagccagctaaaggtaatagtttaacgaaaaaatcatatgagttattaaatcatgatcattcattgaattttgttgggaatattgaagcgaagacattaatggatggcgatacagatgttgtagttaccgatggctatactgggaacatggtccttaaaaatttagaaggtactgcaaaatcaatcggtaaaatgttaaaagatacgattatgagtagtactaaaaataaattagcaggtgcaatattgaagaaagatttagctgaattcgctaaaaagatggattactcagaatacggtggttccgtattattaggattggaaggtactgtagttaaagcacacggtagttcaaatgctaaagctttttattctgcaattagacaagcgaaaatcgcaggagaacaaaatattgtacaaacaatgaaagagactgtaggtgaatcaaatgag

SEQ ID NO: 4936 - protein, 335 aa, Staphylococcus aureus
  MISC_FEATURE (1)..(335): fatty acid/phospholipid
MISEDKIMVKLAIDMMGGDNAPDIVLEAVQKAVEDFKDLEIILFGDEKKYNLNHERIEFRHCSEKIEMEDEPVRAIKRKKDSSMVKMAEAVKSGEADGCVSAGNTGALMSAGLFIVGRIKGVARPALVVTLPTIDGKGFVFLDVGANADAKPEHLLQYAQLGDIYAQKIRGIDNPKISLLNIGTEPAKGNSLTKKSYELLNHDHSLNFVGNIEAKTLMDGDTDVVVTDGYTGNMVLKNLEGTAKSIGKMLKDTIMSSTKNKLAGAILKKDLAEFAKKMDYSEYGGSVLLGLEGTVVKAHGSSNAKAFYSAIRQAKIAGEQNIVQTMKETVGESNE

SEQ ID NO: 4937 - DNA, 402 bp, Staphylococcus aureus
gtggggggaatcagtatgttacatttacatatattaagttgggtattagcgattattttatttatcgctacatacttaaacatttcaaaaaatcaaggcagatcaccatttttcaaaccgttgcacatgattttacgcttatttatgctgttgacgttaatttcaggattttggatattaattcagtcatttatgaatggcggggcaaatcatatgttgcttacattgaaaatgctgtgtggtgttgcagtagttggattgatggaagtgtcgattgctaaaagaaagagacatgaacaaagtcacacaatgttttggataacaattgcattaattatcatcacaatggtattaggtgtcattctaccgttagggcctatatcaaaattattcggtattggc

SEQ ID NO: 4938 - protein, 134 aa, Staphylococcus aureus
  MISC_FEATURE (1)..(134): conserved hypothetical
VGGISMLHLHILSWVLAIILFIATYLNISKNQGRSPFFKPLHMILRLFMLLTLISGFWILIQSFMNGGANHMLLTLKMLCGVAVVGLMEVSIAKRKRHEQSHTMFWITIALIIITMVLGVILPLGPISKLFGIG

SEQ ID NO: 4939 - DNA, 900 bp, Staphylococcus aureus
atgaaattcttatcattcaagtataatgacaaaacttcatatggcgttaaagtaaaacgcgaagatgctgtatgggatttaacacaagtatttgctgactttgcagaaggagatttccatcctaaaacattgttagctggtttacaacaaaatcatactttagattttcaagaacaagtacgtaaagcagttgtagcagcagaagatagcggcaaagctgaagactataaaatttcatttaatgacattgaatttttaccaccagtaacacctccgaataatgtgattgcttttggtagaaattacaaagatcatgcgaacgaattaaatcatgaagtggaaaaattatatgtatttacaaaagcagcgtcatctttaacaggagataatgcaacaattccaaatcataaagatattactgatcaattagattatgaaggtgaattaggtattgttattggtaagtctggtgaaaagattccaaaagcattagctttagattatgtttacggctatacaattattaacgatatcactgatcgcaaagcacaaagtgaacaagatcaagcatttttatcaaaaagtttaactggcggttgcccaatgggtccttatatcgttactaaagacgaactaccattacctgaaaatgtaaatattgttacaaaagttaacaatgaaattagacaagatggtaacactggcgaaatgattcttaaaattgatgaattaatagaagaaatttcaaaatatgttgcactacatccgggagatattattgcaactggtacaccagcaggcgttggtgcaggtatgcaaccacctaaatttttacaaccaggtgatgaagttaaagtgactattgataatattggaacgctgacaacttatatcgctaaa

SEQ ID NO: 4940 - protein, 300 aa, Staphylococcus aureus
  MISC_FEATURE (1)..(300): hypothetical protein
MKFLSFKYNDKTSYGVKVKREDAVWDLTQVFADFAEGDFHPKTLLAGLQQNHTLDFQEQVRKAVVAAEDSGKAEDYKISFNDIEFLPPVTPPNNVIAFGRNYKDHANELNHEVEKLYVFTKAASSLTGDNATIPNHKDITDQLDYEGELGIVIGKSGEKIPKALALDYVYGYTIINDITDRKAQSEQDQAFLSKSLTGGCPMGPYIVTKDELPLPENVNIVTKVNNEIRQDGNTGEMILKIDELIEEISKYVALHPGDIIATGTPAGVGAGMQPPKFLQPGDEVKVTIDNIGTLTTYIAK

SEQ ID NO: 4941 - DNA, 3651 bp, Staphylococcus aureus
atgacaattccagagaaaccacaaggcgtgatttggactgacgcgcaatggcaaagtatttacgcaactggacaagatgtacttgttgcagccgcggcaggttcaggtaaaacagctgtactagttgagcgtattatccaaaagattttacgtgatggcattgatgtcgatcgacttttagtcgtaacgtttacaaacttaagcgcacgtgaaatgaagcatcgtgtagaccaacgtattcaagaggcatcgattgctgatcctgcaaatgcacacttgaaaaaccaacgcatcaaaattcatcaagcacaaatatctacactccatagtttttgcttgaaattaattcaacagcattatgatgtattaaatattgacccgaactttagaacaagcagtgaagctgaaaatattttattattagaacaaacgatagatgaggtcatagaacaacattacgatatccttgatcctgcttttattgaattaacagagcaattgtcttcagatagaagtgatgatcagtttcgaatgattattaaacaattgtatttctttagcgttgcaaatccaaatcctacaaattggttggatcaattggtgacaccatacgaagaagaagcacaacaagcgcaacttattcaactactaacagacttatctaaagtatttatcacagctgcttatgatgctttaaataaggcgtatgatttgtttagtatgatggatagcgtcgataaacatttagctgttatagaagatgaacgacgtttaatggggcgtgttttagaaggtggctttattgatataccttatttaactggtcacgaatttggcgcgcgtttgcctaatgtaacagcgaaaattaaagaagcaaatgaaatgatggtcgatgccttagaagatgctaaacttcagtataaaaaatataaatcattaattgataaagtgaagagtgattacttttcaagagaagctgatgatttgaaagctgatatgcaacaattggcgccacgagtaaagtaccttgcgcgtattgtgaaagatgttatgtcagaattcaatcgaaaaaagcgtagcaaaaatattttggatttttctgattatgaacattttgcattacaaattttaactaatgaggatggttcgccttcagaaattgccgaatcataccgtcaacacttccaagaaatattggtcgatgagtatcaagatacgaaccgagttcaagagaaaatactatcttgcatcaaaacgggtgatgaacataatggtaatttatttatggttggagatgttaagcaatccatttataaatttagacaagctgatccaagtttatttattgaaaagtatcaacgctttactatagatggagatggcactggacgtcgaattgatttgtcgcaaaacttccgttctcgaaaagaagtactgtcaacgactaactatatattcaaacatatgatggatgaacaagtcggtgaagtaaaatatgatgaagcggcacagttgtattatggtgcaccatatgatgaatcggaccatccagtaaacttaaaagtccttgttgaagcggatcaagaacatagtgatttaactggtagtgaacaagaagcgcattttatagtagaacaagttaaagatatcttagaacatcaaaaagtttatgatatgaaaacaggaagctatagaagtgcgacatacaaggatatcgttattctagaacgcagctttggacaagctcgcaatttacaacaagcctttaaaaatgaagatattccattccatgtgaatagtcgtgaaggttactttgaacaaacagaagtccgcttagtattatcatttttaagagcgatagataatccattacaagatatttatttagttgggttaatgcgctccgttatatatcagttcaaagaagacgaattagctcaaattagaatattgagtccaaatgatgactacttctatcaatcgattgtaaattacattaatgacgaagcagcagatgcaattttagttgataaattaaaaatgtttttatcagatattcaaagttaccaacaatatagtaaagatcatccggtgtatcagttaattgataaattttataatgatcattatgttattcaatactttagtggacttattggtggacgtggacgacgtgcaaatctttatggtttatttaataaagctatcgagtttgagaattcaagttttagaggtttatatcaatttattcgttttatcgatgaattgattgaaagaggcaaagattttggtgaggaaaatgtagttggtccaaacgataatgtcgttagaatgatgacaattcatagtagtaaaggtctagagtttccatttgtcatttattctggattgtcaaaagattttaataaacgtgatttgaaacaaccagttattttaaatcagcaatttggtctcggaatggattattttgatgtggataaagaaatggcatttccatctttagcttcggttgcatatagagctgttgccgaaaaagaacttgtgtcagaagaaatgcgattagtctatgtagcattaacaagagcgaaagaacaactttatttaattggtagagtgaaaaatgataaatcattactagaactagagcaattgtctatttctggtgagcacattgctgtcaatgaacgattaacttcaccaaatccgttccatcttatttatagtattttatctaaacatcaatctgcgtcaattccagatgatttaaaatttgaaaaagatatagcacaaattgaagatagtagtcgtccgaatgtaaatatttcaattgtgtactttgaagatgtgtctacagaaaccattttagataatgatgaatatcgttcggttaatcaattagaaactatgcaaaatggtaatgaagatgttaaagcacaaattaaacaccaacttgattatcgatatccatatgtaaatgatactaaaaagccctcaaaacaatctgtttctgaattgaaaagacaatatgaaacagaagaaagtggcacaagttacgaacgagtaaggcaatatcgtatcggtttttcaacgtatgaacgacctaaatttctaagtgaacaaggtaaacgaaaagcgaatgaaattggtacgttaatgcatacagtgatgcaacatttaccattcaaaaaagaacgcatatctgaagttgagttacatcagtatatcgatggattaatcgataaacatattatcgaagcagatgcgaaaaaagatatccgtatggatgaaataatgacatttatcaatagtgagttatattcgattattgctgaagcagagcaagtttatcgtgaattaccgtttgtagttaaccaagcattagttgaccaattgccacaaggagacgaagacgtctcaattattcaaggtatgattgacttaatctttgttaaagatggtgtgcattattttgtagactataaaaccgatgcatttaatcgtcgccgtgggatgacagatgaagaaattggtacacaattaaaaaataaatataagatacagatgaaatattatcaaaatacgcttcaaacgattcttaataaagaagttaaaggttatttatacttcttcaaatttggtacattgcaacta

SEQ ID NO: 4942 - protein, 1217 aa, Staphylococcus aureus
  MISC_FEATURE (1)..(1217): hypothetical protein
MTIPEKPQGVIWTDAQWQSIYATGQDVLVAAAAGSGKTAVLVERIIQKILRDGIDVDRLLVVTFTNLSAREMKHRVDQRIQEASIADPANAHLKNQRIKIHQAQISTLHSFCLKLIQQHYDVLNIDPNFRTSSEAENILLLEQTIDEVIEQHYDILDPAFIELTEQLSSDRSDDQFRMIIKQLYFFSVANPNPTNWLDQLVTPYEEEAQQAQLIQLLTDLSKVFITAAYDALNKAYDLFSMMDSVDKHLAVIEDERRLMGRVLEGGFIDIPYLTGHEFGARLPNVTAKIKEANEMMVDALEDAKLQYKKYKSLIDKVKSDYFSREADDLKADMQQLAPRVKYLARIVKDVMSEFNRKKRSKNILDFSDYEHFALQILTNEDGSPSEIAESYRQHFQEILVDEYQDTNRVQEKILSCIKTGDEHNGNLFMVGDVKQSIYKFRQADPSLFIEKYQRFTIDGDGTGRRIDLSQNFRSRKEVLSTTNYIFKHMMDEQVGEVKYDEAAQLYYGAPYDESDHPVNLKVLVEADQEHSDLTGSEQEAHFIVEQVKDILEHQKVYDMKTGSYRSATYKDIVILERSFGQARNLQQAFKNEDIPFHVNSREGYFEQTEVRLVLSFLRAIDNPLQDIYLVGLMRSVIYQFKEDELAQIRILSPNDDYFYQSIVNYINDEAADAILVDKLKMFLSDIQSYQQYSKDHPVYQLIDKFYNDHYVIQYFSGLIGGRGRRANLYGLFNKAIEFENSSFRGLYQFIRFIDELIERGKDFGEENVVGPNDNVVRMMTIHSSKGLEFPFVIYSGLSKDFNKRDLKQPVILNQQFGLGMDYFDVDKEMAFPSLASVAYRAVAEKELVSEEMRLVYVALTRAKEQLYLIGRVKNDKSLLELEQLSISGEHIAVNERLTSPNPFHLIYSILSKHQSASIPDDLKFEKDIAQIEDSSRPNVNISIVYFEDVSTETILDNDEYRSVNQLETMQNGNEDVKAQIKHQLDYRYPYVNDTKKPSKQSVSELKRQYETEESGTSYERVRQYRIGFSTYERPKFLSEQGKRKANEIGTLMHTVMQHLPFKKERISEVELHQYIDGLIDKHIIEADAKKDIRMDEIMTFINSELYSIIAEAEQVYRELPFVVNQALVDQLPQGDEDVSIIQGMIDLIFVKDGVHYFVDYKTDAFNRRRGMTDEEIGTQLKNKYKIQMKYYQNTLQTILNKEVKGYLYFFKFGTLQL

SEQ ID NO: 4943 - DNA, 3474 bp, Staphylococcus aureus
atgacattacatgcttatttaggtagagcgggaacaggtaagtctacgaaaatgttgaccgaaataaaacaaaaaatgaaagcagatccgcttggagatccaatcattttaattgcgccaactcaaagtacatttcaattagaacaagcctttgtcaatgatccggaattaaatggtagtttaagaacagaagtgttgcattttgaacgattaagtcatcgtattttccaagaagttggtagttatagcgaacaaaagttatctaaagctgcaacggaaatgatgatttataacattgttcaagaacaacaaaagtatttaaaactttatcaatcacaagcaaaatattatgggtttagtgaaaaattaacagaacaaattcaagattttaaaaaatatgcagtaacgcctgaacatttagaacactttattgctgataaaaatatgcaaactcgaactaaaaataagttagaggatattgctttaatataccgtgagttcgaacaacgcattcaaaacgagtttattacgggtgaggattcattacaatattttattgattgtatgccgaaatcagagtggctaaaacgtgctgatatatatattgatggttttcacaacttttcaacgattgagtatttaataatcaaaggattaattaaatatgcgaagagtgtcacaattatattgacgacagatggtaaccacgatcaatttagtttatttagaaaaccatcggaagtgttacgacatattgaagaaatagcaaatgaactcaatatttctattgaacgtcaatatttcaaccaattatatcgcttcaataatcaagatttaaagcatcttgaacaagaatttgatgcacttcaaatcaatcgagtggcatgtcaaggtcatatcaatattttagaatctgcgactatgagagaggaaataaatgaaattgcgcgacgtatcatcgttgatattcgtgataagcaattacgatatcaagatattgctattttatatcgtgatgaatcttatgcttatttatttgattccatattaccgctttataatattccttataatattgatacaaagcgttcgatgacacatcatccggtcatggaaatgattcgttcattgattgaagttattcaatctaattggcaagtgaatccaatgctacgcttattgaagactgatgtgttaacggcatcatatctaaaaagtgcatacttagttgatttacttgaaaattttgtacttgaacgtggtatatacggtaaacgttggttagatgatgagctatttaatgtcgaacattttagcaaaatggggcgtaaagcgcataaactgaccgaagatgaacgtaacacatttgaacaagtcgttaagttaaagaaagatgtcattgataaaattttacattttgaaaagcaaatgtcacaagcggaaactgtaaaagattttgcaactgctttttatgaaagtatggaatatttcgaactgccaaatcaattgatgacagagcgagatgaacttgatttaaatggtaatcatgaaaaggcggaggaaattgatcaaatatggaatggcttaattcaaatccttgatgacttagttctagtatttggagatgaaccaatgtcgatggaacgtttcttagaagtatttgatattggtttagaacaattagaatttgttatgattccgcaaacattggaccaagtaagtattggtacgatggatttggctaaagtcgataataagcaacatgtttacttagtaggtatgaatgatggaacgatgccacaaccagtaactgcgtcaagcttgattacagatgaagaaaagaaatactttgaacagcaggctaatgtcgagttaagtccaacatcagatattttacagatggatgaagcatttgtttgttatgttgctatgactagagctaagggagatgttacattttcttacagtctaatgggatcaagtggtgatgataaggagatcagcccatttttaaatcaaattcaatcattgttcaaccaattggaaattactaacattcctcaataccatgaagttaacccattgtcactaatgcaacatgctaagcaaaccaaaattacattatttgaagcattgcgtgcttggttatatgatgaaattgtggctgatagttggttagatgcttatcaagtaattagagatagcgatcatttaaatcaaggtttagattatttaatgtcagcattaacgtttgacaatgaaactgtaaaattaggtgaaacgttgtctaaagatttatatggtaaggaaatcaatgccagtgtatcccgttttgaaggttatcaacaatgcccatttaaacactatgcgtcacatggtctgaaactaaatgagcgaacgaagtatgaacttcaaaactttgatttaggtgatattttccattctgttttaaaatatatatctgaacgtattaatggcgattttaaacaattagacctgaaaaaaataagacaattaacgaatgaagcattggaagaaattttacctaaagttcagtttaatttattaaattcttcagcttactatcgttatttatcaagacgcattggcgctattgtagaaacaacactaagcgcattaaaatatcaaggcacgtattcaaagtttatgccaaaacattttgagacaagttttagaaggaaaccaagaacaaatgacgaattaattgcacaaacattaacgacaactcaaggtattccaattaatattagagggcaaattgaccgtatcgatacgtatacaaagaatgatacaagttttgttaatatcattgactataaatcctctgaaggtagtgcgacacttgatttaacgaaagtatattatggtatgcaaatgcaaatgatgacatacatggatatcgttttacaaaataaacaacgccttggattaacagatattgtgaaaccaggtggattattatacttccatgtacatgaacctagaattaaatttaaatcatggtctgatattgatgaagataaactagaacaagatttaattaaaaagtttaagttgagtggtttagttaatgcagaccaaactgttattgatgcattggatattcgtttagaacctaaattcacttcagatattgtaccagttggtttgaataaagatggctctttgagtaaacgaggcagccaagtggcagatgaagcaacgatttataaattcatccaacataacaaagagaattttatagaaacagcttcaaatattatggatggacatactgaagttgcaccattaaagtacaaacaaaaattgccatgtgctttttgtagttatcaatcggtatgtcatgtagatggcatgattgatagtaagcgatatcgaactgtagatgaaacaataaatccaattgaagcaattcaaaatattaacattaatgatgaatttgggggtgagcaa

SEQ ID NO: 4944 - protein, 1158 aa, Staphylococcus aureus
  MISC_FEATURE (1)..(1158): hypothetical protein
MTLHAYLGRAGTGKSTKMLTEIKQKMKADPLGDPIILIAPTQSTFQLEQAFVNDPELNGSLRTEVLHFERLSHRIFQEVGSYSEQKLSKAATEMMIYNIVQEQQKYLKLYQSQAKYYGFSEKLTEQIQDFKKYAVTPEHLEHFIADKNMQTRTKNKLEDIALIYREFEQRIQNEFITGEDSLQYFIDCMPKSEWLKRADIYIDGFHNFSTIEYLIIKGLIKYAKSVTIILTTDGNHDQFSLFRKPSEVLRHIEEIANELNISIERQYFNQLYRFNNQDLKHLEQEFDALQINRVACQGHINILESATMREEINEIARRIIVDIRDKQLRYQDIAILYRDESYAYLFDSILPLYNIPYNIDTKRSMTHHPVMEMIRSLIEVIQSNWQVNPMLRLLKTDVLTASYLKSAYLVDLLENFVLERGIYGKRWLDDELFNVEHFSKMGRKAHKLTEDERNTFEQVVKLKKDVIDKILHFEKQMSQAETVKDFATAFYESMEYFELPNQLMTERDELDLNGNHEKAEEIDQIWNGLIQILDDLVLVFGDEPMSMERFLEVFDIGLEQLEFVMIPQTLDQVSIGTMDLAKVDNKQHVYLVGMNDGTMPQPVTASSLITDEEKKYFEQQANVELSPTSDILQMDEAFVCYVAMTRAKGDVTFSYSLMGSSGDDKEISPFLNQIQSLFNQLEITNIPQYHEVNPLSLMQHAKQTKITLFEALRAWLYDEIVADSWLDAYQVIRDSDHLNQGLDYLMSALTFDNETVKLGETLSKDLYGKEINASVSRFEGYQQCPFKHYASHGLKLNERTKYELQNFDLGDIFHSVLKYISERINGDFKQLDLKKIRQLTNEALEEILPKVQFNLLNSSAYYRYLSRRIGAIVETTLSALKYQGTYSKFMPKHFETSFRRKPRTNDELIAQTLTTTQGIPINIRGQIDRIDTYTKNDTSFVNIIDYKSSEGSATLDLTKVYYGMQMQMMTYMDIVLQNKQRLGLTDIVKPGGLLYFHVHEPRIKFKSWSDIDEDKLEQDLIKKFKLSGLVNADQTVIDALDIRLEPKFTSDIVPVGLNKDGSLSKRGSQVADEATIYKFIQHNKENFIETASNIMDGHTEVAPLKYKQKLPCAFCSYQSVCHVDGMIDSKRYRTVDETINPIEAIQNININDEFGGEQ

SEQ ID NO: 4945 - DNA, 582 bp, Staphylococcus aureus
gtgtcaaaattgaaaaaagaaatattggaatggattatttcaattgcagtcgcttttgtcattttatttatagtaggtaaatttattgttacgccatatacaattaaaggtgaatcaatggatccaactttgaaagatggcgagcgagtagctgtaaacattgttggatataaaacaggtggtttggaaaaaggtaatgtagttgtcttccatgcaaacaaaaatgatgactatgttaaacgtgtcatcggtgttcctggtgataaagtagaatacaaaaatgatacattatatgtcaatggtaaaaaacaagatgaaccatatttaaactacaatttaaaacataaacaaggtgattacattactgggactttccaagttaaagatttaccgaatgcgaatcctaaatcaaatgtcattccaaaaggtaaatatttagtgcttggagataatcgtgaagtaagtaaagatagccgtgcgtttggcctcattgatgaagaccaaattgttggtaaagtttcatttaggttctggccatttagtgaatttaaacataatttcaatcctgaaaatactaaaaat

SEQ ID NO: 4946 - protein, 194 aa, Staphylococcus aureus
  MISC_FEATURE (1)..(194): type-1 signal peptidase 1B
VSKLKKEILEWIISIAVAFVILFIVGKFIVTPYTIKGESMDPTLKDGERVAVNIVGYKTGGLEKGNVVVFHANKNDDYVKRVIGVPGDKVEYKNDTLYVNGKKQDEPYLNYNLKHKQGDYITGTFQVKDLPNANPKSNVIPKGKYLVLGDNREVSKDSRAFGLIDEDQIVGKVSFRFWPFSEFKHNFNPENTKN

SEQ ID NO: 4947 - DNA, 522 bp, Staphylococcus aureus
gtgaaaaaagttgtaaaatatttgatttcattgatacttgctattatcattgtactgttcgtacaaacttttgtaatagttggtcatgtcattccgaataatgatatgtcaccaacccttaacaaaggggatcgtgttattgtaaataaaattaaagttacatttaatcaattgaataatggtgatatcattacatataggcgtggtaacgagatatatactagtcgaattattgccaaacctggtcaatcaatggcgtttcgtcagggacaattataccgtgatgaccgaccggttgacgcatcttatgccaagaacagaaaaattaaagattttagtttgcgcaattttaaagaattagatggtgatattattccgccaaacaattttgttgtgctaaatgatcaagataataacaagcacgattcaagacaatttggtttaatcgataaaaaggatattattggtaatgttagtttacgatactatcctttttcaaaatggactgttcagttcaaatct

SEQ ID NO: 4948 - protein, 174 aa, Staphylococcus aureus
  MISC_FEATURE (1)..(174): type-I signal peptidase
VKKVVKYLISLILAIIIVLFVQTFVIVGHVIPNNDMSPTLNKGDRVIVNKIKVTFNQLNNGDIITYRRGNEIYTSRIIAKPGQSMAFRQGQLYRDDRPVDASYAKNRKIKDFSLRNFKELDGDIIPPNNFVVLNDQDNNKHDSRQFGLIDKKDIIGNVSLRYYPFSKWTVQFKS

SEQ ID NO: 4949 - DNA, 573 bp, Staphylococcus aureus
ttgtcgtttcatcaagtagaagaatggtttgagatatttcgacagtttggttatttacctggatttatattgttatatattagagctataattccagtatttcctttagcactctatattttaattaacattcaagcttatggacctattttaggtatattgattagttggcttggattaatttctggaacatttacagtctatttgatctgtaaacgattggtgaacactgagaggatgcagcgaattaaacaacgtactgctgttcaacgcttgattagttttattgatcgccaaggattaatcccattgtttattttactttgttttccttttacgccaaatacattaataaattttgtagcgagtctatctcatattagacctaaatattatttcattgttttggcatcatcaaagttagtttcaacaattattttaggttatttaggtaaggaaattactacaattttaacgcatcctttaagagggatattaatgttagttgtgttggttgtattttggattgttggaaaaaagttagaacagcattttatgggatcgaaaaaggag

SEQ ID NO: 4950 - protein, 191 aa, Staphylococcus aureus
  MISC_FEATURE (1)..(191): conserved hypothetical
LSFHQVEEWFEIFRQFGYLPGFILLYIRAIIPVFPLALYILINIQAYGPILGILISWLGLISGTFTVYLICKRLVNTERMQRIKQRTAVQRLISFIDRQGLIPLFILLCFPFTPNTLINFVASLSHIRPKYYFIVLASSKLVSTIILGYLGKEITTILTHPLRGILMLVVLVVFWIVGKKLEQHFMGSKKE

SEQ ID NO: 4951 - DNA, 1329 bp, Staphylococcus aureus
atgactcatattcaattagattttagtaaaacgttagaatttttcggtgaacacgaattaaaacaacaacaagaaattgttaaatcaattcacaaaacaattcatgaaggtactggtgcaggtagtgacttcttaggctggattgatttaccagttgattacgacaaagaagaattttcaagaattgttgaagcatcaaaacgcattaaagaaaattctgatgttttagtagtcatcggtattggtggttcttacttaggtgcacgtgcagcaatcgaaatgttaacgtcatcatttagaaacagcaatgaataccctgaaattgtatttgttggtaatcacttatcatcaacatatacgaaagagttagttgattatttagcagacaaagatttctctgtaaacgttatttctaaatctggtacaactacagaaccagcagttgcatttagattgttcaaacaattagttgaagaaagatacggtaaagaagaagcacaaaaacgtatatttgcaacaacggataaagaaaaaggtgctttaaaacagttggctacaaacgaaggttatgaaacgtttatcgtacctgatgatgtaggtggaagatattctgttttaacagcagtaggattattaccaattgcaacagctggaattaacatcgaagctatgatgattggtgctgcaaaagcacgtgaagaattatcttcagataaattagaagaaaacattgcataccaatatgcgacaattcgaaacattttatatgcaaaaggttatacaacagaaatgttgattaactatgaaccatctatgcaatactttaatgaatggtggaaacaattatttggtgaatcagaaggtaaagacttcaaaggtatctatccttcaagtgccaactacacaactgatttacattctttaggtcaatatgtacaagaaggccgtcgcttcttattcgaaacagttgtaaaagtaaatcatcctaaatatgatattactattgaaaaagatagtgatgatctagacggattaaattatttagctggtaaaacaatcgacgaagttaacacaaaagcattcgaaggtacattattagcgcatactgatggtggtgttcctaacatggtagtgaacattccacaattagatgaagaaactttcggttacgtcgtatacttcttcgaacttgcttgtgcaatgagtggataccaattaggcgtaaatccatttaaccaacctggtgtagaagcatataaacaaaacatgttcgcattattaggtaaacctggttttgaagacttgaaaaaagaattagaagaacgttta

SEQ ID NO: 4952 - protein, 443 aa, Staphylococcus aureus
  MISC_FEATURE (1)..(443): glucose-6-phosphate
MTHIQLDFSKTLEFFGEHELKQQQEIVKSIHKTIHEGTGAGSDFLGWIDLPVDYDKEEFSRIVEASKRIKENSDVLVVIGIGGSYLGARAAIEMLTSSFRNSNEYPEIVFVGNHLSSTYTKELVDYLADKDFSVNVISKSGTTTEPAVAFRLFKQLVEERYGKEEAQKRIFATTDKEKGALKQLATNEGYETFIVPDDVGGRYSVLTAVGLLPIATAGINIEAMMIGAAKAREELSSDKLEENIAYQYATIRNILYAKGYTTEMLINYEPSMQYFNEWWKQLFGESEGKDFKGIYPSSANYTTDLHSLGQYVQEGRRFLFETVVKVNHPKYDITIEKDSDDLDGLNYLAGKTIDEVNTKAFEGTLLAHTDGGVPNMVVNIPQLDEETFGYVVYFFELACAMSGYQLGVNPFNQPGVEAYKQNMFALLGKPGFEDLKKELEERL

SEQ ID NO: 4953 - DNA, 1011 bp, Staphylococcus aureus
atgcgtggcgaaccagcaatctataataagtttactcgtgcaaaaatggcattatcaacagctgatttagttatcgaactaccagcaactgccagtttatcatctggcgatcattttgccgaactagcagttaaagtcgcagattatatgagtgtcgatacaattgcatttggtagtgaaaataatgatatcaaaacattaaagcaattagcacacagcattaatgaaattgaacaatctgaatccttttcacaaaaagtaaaagaaggtaaaagctaccctcgtatcattagcgaattattagagcatcatgaagcactagcaagtcctaacaacatacttggtattagttacctgaaagcaattgctaaaaatgctaaaaacatcaatgcaatttctatcaaacgagaaaatgctcaacatcatgattcattaattcaacaccatcagtttgcaagtggtacatctattagaacatcaatcattagtcaagatgatcattggcatcatgtggtacctaaagatattcaacacttgtacgtaacacctcatataacattaaatcaaatatttccatatttgaaatatcaaatcatagctatgactacagattcattaaaaaatatttatactgttactgaaggttttgaaaatcgtttgaaatctaacatttatgaagcaactgattttcatcattttgtaaaattactaaaaacaaagcgttatacatatacgcatatccaaagactgttaatgaatgtattattaaacattaaacctacagatgttacgagtaacattcacgcagttaaagtattagcgatgaacgaccgtggcagacaatatttaaagcatttaaaaacagcgttcccagaaagacaatatataaccaatattaacaaaagcaatgcacattacttcacaaatgaaatcaaagcaacacacatatacaatgcaataagcgggcaacaacaaacagatttcaacacgcctgtcatacagcaatatcgt

SEQ ID NO: 4954 - protein, 337 aa, Staphylococcus aureus
  MISC_FEATURE (1)..(337): conserved hypothetical
MRGEPAIYNKFTRAKMALSTADLVIELPATASLSSGDHFAELAVKVADYMSVDTIAFGSENNDIKTLKQLAHSINEIEQSESFSQKVKEGKSYPRIISELLEHHEALASPNNILGISYLKAIAKNAKNINAISIKRENAQHHDSLIQHHQFASGTSIRTSIISQDDHWHHVVPKDIQHLYVTPHITLNQIFPYLKYQIIAMTTDSLKNIYTVTEGFENRLKSNIYEATDFHHFVKLLKTKRYTYTHIQRLLMNVLLNIKPTDVTSNIHAVKVLAMNDRGRQYLKHLKTAFPERQYITNINKSNAHYFTNEIKATHIYNAISGQQQTDFNTPVIQQYR

SEQ ID NO: 4955 - DNA, 480 bp, Staphylococcus aureus
atggaacatacaatagcggtcattccgggtagttttgaccccattacttatggtcatttagacattattgagagaagtacagatagatttgatgaaattcatgtctgtgttcttaaaaatagtaaaaaagaaggtacgtttagtttagaagagcgtatggatttaattgaacaatctgttaaacatttacctaatgtcaaggttcatcaatttagtggtttactagtcgattattgtgaacaagtaggagctaaaacaatcatacgtggtttaagagcagtcagtgattttgaatatgaattacgcttaacttcaatgaataaaaagttgaacaatgaaattgaaacgttatatatgatgtctagtactaattattcatttataagttcaagtattgttaaagaagttgcagcttatcgagcagatatttctgaattcgttccaccttatgttgaaaaggcattgaagaagaaatttaag

SEQ ID NO: 4956 - protein, 160 aa, Staphylococcus aureus
  MISC_FEATURE (1)..(160): phosphopantetheine
MEHTIAVIPGSFDPITYGHLDIIERSTDRFDEIHVCVLKNSKKEGTFSLEERMDLIEQSVKHLPNVKVHQFSGLLVDYCEQVGAKTIIRGLRAVSDFEYELRLTSMNKKLNNEIETLYMMSSTNYSFISSSIVKEVAAYRADISEFVPPYVEKALKKKFK

SEQ ID NO: 4957 - DNA, 570 bp, Staphylococcus aureus
atgaggggtgagacgttgaaactaaagaaagataaacgtagagaagcaatcagacaacaaattgatagcaatcccttcatcacagaccatgaactaagcgacttatttcaagtgagtatacaaacaattcgtttagatcgcacttatttaaacataccagaattaaggaagcgtattaaattagttgctgaaaagaattatgaccaaataagttctattgaagaacaagaatttattggtgatttgattcaagtcaatccaaatgttaaagcgcaatcaattttagatattacatcggattctgtttttcataaaactggaattgcgcgtggtcatgtgctgtttgctcaggcaaattcgttatgtgttgcgctaattaagcaaccaacagttttaactcatgagagtagcattcaatttattgaaaaagtaaaattaaatgatacggtaagagcagaagcacgagttgtaaatcaaactgcaaaacattattacgtcgaagtaaagtcatatgttaaacatacattagttttcaaaggaaattttaaaatgttttatgataagcgagga

SEQ ID NO: 4958 - protein, 190 aa, Staphylococcus aureus
  MISC_FEATURE (1)..(190): conserved hypothetical
MRGETLKLKKDKRREAIRQQIDSNPFITDHELSDLFQVSIQTIRLDRTYLNIPELRKRIKLVAEKNYDQISSIEEQEFIGDLIQVNPNVKAQSILDITSDSVFHKTGIARGHVLFAQANSLCVALIKQPTVLTHESSIQFIEKVKLNDTVRAEARVVNQTAKHYYVEVKSYVKHTLVFKGNFKMFYDKRG

SEQ ID NO: 4959 - DNA, 549 bp, Staphylococcus aureus
gtgaacaacatgcgcgtcattgcaggtaaacataaaagtaaagctttagaaagtatggaaggccgtaatacgagaccaactatggataaagttaaagaaggtatctttaatagtttatatgatgtgtcaggtataggtttagatttatttgcaggaagcggggcgcttggaatagaagcactctctcgaggtatggataaggtaatctttgttgatcaaaattttaaagctgtaaaagttattaaatcaaatcttgcgaatttggatttagaggcacaatctgaagtttataaaaataatgcagatagagctttaaaagcattgtcaaaacgtgatattcaatttgatgtcattttcttagatccaccttataataaaggtctcattgataaagctttaaaactaatttcagagtttaatttattgaaagaaaatggtatcatcgtttgtgaatttagcaatcatgaagaaatagattatcaaccgtttaatatgattaaacgttaccattatgggttgacagacacattgttattagaaaagggagaa

SEQ ID NO: 4960 - protein, 183 aa, Staphylococcus aureus
  MISC_FEATURE (1)..(183): conserved hypothetical
VNNMRVIAGKHKSKALESMEGRNTRPTMDKVKEGIFNSLYDVSGIGLDLFAGSGALGIEALSRGMDKVIFVDQNFKAVKVIKSNLANLDLEAQSEVYKNNADRALKALSKRDIQFDVIFLDPPYNKGLIDKALKLISEFNLLKENGIIVCEFSNHEEIDYQPFNMIKRYHYGLTDTLLLEKGE

SEQ ID NO: 4961 - DNA, 387 bp, Staphylococcus aureus
atgaaacaaacatttattacacttggtgaaggtctaacagatttgttcgaattcatgacgatgattgaatataaccatcaacgtattgataaaattatctattttcattcaccacaagctgaaaataaaaagtcatctgtagcaatcattatgaaccctacaactggcaatcatttccaagcattttatatcatgataaacgctattaaatatccatatccagattcaaataaaaagtttcaaatgataaatgattgtgctgaaaaattcgacataccaattttaggtatcgatgtacagccccctcaagcatttcatgatttatcgttatattataattatttaattagtgtgttaaggctccaaaaatggataccagaacttcaa

SEQ ID NO: 4962 - protein, 129 aa, Staphylococcus aureus
  MISC_FEATURE (1)..(129): conserved hypothetical
MKQTFITLGEGLTDLFEFMTMIEYNHQRIDKIIYFHSPQAENKKSSVAIIMNPTTGNHFQAFYIMINAIKYPYPDSNKKFQMINDCAEKFDIPILGIDVQPPQAFHDLSLYYNYLISVLRLQKWIPELQ

SEQ ID NO: 4963 - DNA, 252 bp, Staphylococcus aureus
atgaatttaatcccaagaactagtattgtagtttatttaaaacatatgaaacatgaacgacaaatccgaaaatatggacatatcgttcattcaaatagagatcgtaaatttgtaattatgtatgtgaatgagcaagatgttgatcaaattgtacataaactaatgcaacttaaatacgttagacacattgatggctcaccatataaatacttaaagaaaacttacgaaaaagagaaacacgaaatatataat

SEQ ID NO: 4964 - protein, 84 aa, Staphylococcus aureus
  MISC_FEATURE (1)..(84): conserved hypothetical
MNLIPRTSIVVYLKHMKHERQIRKYGHIVHSNRDRKFVIMYVNEQDVDQIVHKLMQLKYVRHIDGSPYKYLKKTYEKEKHEIYN

SEQ ID NO: 4965 - DNA, 924 bp, Staphylococcus aureus
atgaaaaaagtaaacagaaacattttaaatgcggtactagtcggtgctggatttttaagtagtctattaatgatcaataaaaataaagtgattactaaaaagcaaaccatccctgcttttttcaaaggcaatgcaccatatatatttgcgcatcgcggtggtatggctttaagaccagagcaaacgcaacttgcatttgactatgctaaacaattaggcgttgatggctttgaaacagatgtgagactcacaaaagatcaacagcttatcgtttttcatgacgcaactgttgatagaacgacgaacggctctggaaaagttagtgcccatacattagcagaattaaagaaattagacgcagcttatcacttcaaagatatcaatggactaacaccatatcgtggtcatgcacacacagctatactaaccttcgatgagttgctgaagcaatatcctgatatgtatataaacgtagacttaaaagatgctcctgaatcctatgaaggctcaatcgcaccacaaattatgtttgatacaattgcagaaaatcaagcatttgaccgcgttcttgtgacaagtttttataaagaacaaatcgttcgttttaataaaattgcacaaggatccgtcgcaattggtgctagccaacaggaagttacagaagcatttttaaaatatcatttattaggtggtaggtactaccaaccattagcacaaacgttccaaatgcctactcattttaaaggcattgatttgacttcatctcgttttatcaaatggttaaatgatatgaatatcattccaggctattatggcgtaaatagtataaatctgatgaatgatttataccaaaaaggtgcacacacgattgtgacagatcgaccagatttagcacaacaattcaaacaaacaatcccgaataaa

SEQ ID NO: 4966 - protein, 308 aa, Staphylococcus aureus
  MISC_FEATURE (1)..(308): hypothetical protein
MKKVNRNILNAVLVGAGFLSSLLMINKNKVITKKQTIPAFFKGNAPYIFAHRGGMALRPEQTQLAFDYAKQLGVDGFETDVRLTKDQQLIVFHDATVDRTTNGSGKVSAHTLAELKKLDAAYHFKDINGLTPYRGHAHTAILTFDELLKQYPDMYINVDLKDAPESYEGSIAPQIMFDTIAENQAFDRVLVTSFYKEQIVRFNKIAQGSVAIGASQQEVTEAFLKYHLLGGRYYQPLAQTFQMPTHFKGIDLTSSRFIKWLNDMNIIPGYYGVNSINLMNDLYQKGAHTIVTDRPDLAQQFKQTIPNK

SEQ ID NO: 4967 - DNA, 432 bp, Staphylococcus aureus
atgattaatgaagcttcactagcgatattagatgatattgatgaactagctgatatgatagttgcatcagatatttatgcatcatttgagcaagctaaacaggcgctcgaaaacaatgacgaagcacatttactttatcaatcatttttaaaatcaaaagagaaatatgatgaagtaatgcgattcgggaaatatcatcctgattataagaaagttatgttagagacaagacaacgcaaaagagcatatgagatgcttgacgttgtgatgcattacaaagctagggaaatggcacttcaacatttaatagatgaagttgttacgaaaattgcgtacgctgtttcagaacatgtcaaaatagaaacaggtaatccattctttcaaacatcacatagtggttgtgcgacgggcggatcctgtaattgttcatta

SEQ ID NO: 4968 - protein, 144 aa, Staphylococcus aureus
  MISC_FEATURE (1)..(144): conserved hypothetical
MINEASLAILDDIDELADMIVASDIYASFEQAKQALENNDEAHLLYQSFLKSKEKYDEVMRFGKYHPDYKKVMLETRQRKRAYEMLDVVMHYKAREMALQHLIDEVVTKIAYAVSEHVKIETGNPFFQTSHSGCATGGSCNCSL

SEQ ID NO: 4969 - DNA, 1038 bp, Staphylococcus aureus
ttgatgaaaaagttaattataagagtcgtcggtgtattatttttagttggatttttaatatatcttttttattcaccgagattaaaatttgatgtattagagaacccgaataaaggtaataaagtaaatagatctgaacaggtgaataaatcaaataaccatgctgaaaatccaaagcctaaagaaggtgttggtacatgggtaggtaaagatattaaagtgcttacttctaaatttggacaagcagatcgtgtctacccttttagagatggttacaaaaattatgtgtttaaagacaaaaacagttattacattgtttcaactaaacgtgaagaaatcgtttcagtgtatgctacaggtgagaaagtcaatgttagtccgttaaaaataggacaacattctgcagaaatttttaatcatacaagtattaatccagaaccgtcctttaaagttgatggtaaaaaatatgaatttgaactttcagatgaagatttaaaaacacaaacactgattaaatatggcgacatatatgcacaagtgtattctgatcaacaatcgaaaaaggtgctaagtgtacgatttttaacaaaagaaatgttagcagatattgaaccttatcaattaaattctaattctacgtcagaagagcataataagcgtccagttgagcaaaatccaaatcaattaatttctctttatgaagtaacgaatgaaatgagaaaattaaaaggattaaaaccattgaaaatcaatagcgatttagcacatattgcatctaataacttatatgaagcgacctctaatggttctgatagtgttgaatttacagaggacgcattaagagggcaattagataaaaatcacgttacttataaaacaactgctcaaaatgttggttatgcgtttaatgatgtaccaacattaatccatagttggatgaattcagatatacatcgatctcgtctattaaattcaaaatacgatgagatgggtggagatgtaatgagagattattattcactaattttcttagaaaaa

SEQ ID NO: 4970 - protein, 346 aa, Staphylococcus aureus
  MISC_FEATURE (1)..(346): conserved hypothetical
LMKKLIIRVVGVLFLVGFLIYLFYSPRLKFDVLENPNKGNKVNRSEQVNKSNNHAENPKPKEGVGTWVGKDIKVLTSKFGQADRVYPFRDGYKNYVFKDKNSYYIVSTKREEIVSVYATGEKVNVSPLKIGQHSAEIFNHTSINPEPSFKVDGKKYEFELSDEDLKTQTLIKYGDIYAQVYSDQQSKKVLSVRFLTKEMLADIEPYQLNSNSTSEEHNKRPVEQNPNQLISLYEVTNEMRKLKGLKPLKINSDLAHIASNNLYEATSNGSDSVEFTEDALRGQLDKNHVTYKTTAQNVGYAFNDVPTLIHSWMNSDIHRSRLLNSKYDEMGGDVMRDYYSLIFLEK

SEQ ID NO: 4971 - DNA, 468 bp, Staphylococcus aureus
atgaaaaatatgggcgttccaattttaccaacgattagtacgacatgtattgtcattagtgcaattttaattgccattggttggagacttatttggaaaagggaaataaataaacacaaaaatgttatgttagctgcagctgtttttgctttaacttttttcttaatctatgcaagtagaacgatttttatcggtaatacagcatttggcggaccagcatcaattaagaaatattatacgattttcttatttttccacattaatttagcaacaattggtggtattctaggcctagttcaaattattactgcatttaaagataaatataatgtacaccgcaaattcgggccattcgcttcagttatatggttctgtactgcaattacaggtgtagcagtttacttattattatatgtattatatccaggtggagaaacgacatcactgattaaagcaacatttggtcat

SEQ ID NO: 4972 - protein, 156 aa, Staphylococcus aureus
  MISC_FEATURE (1)..(156): conserved hypothetical
MKNMGVPILPTISTTCIVISAILIAIGWRLIWKREINKHKNVMLAAAVFALTFFLIYASRTIFIGNTAFGGPASIKKYYTIFLFFHINLATIGGILGLVQIITAFKDKYNVHRKFGPFASVIWFCTAITGVAVYLLLYVLYPGGETTSLIKATFGH

SEQ ID NO: 4973 - DNA, 909 bp, Staphylococcus aureus
atgagcaaagagcatactttgtcacaaaatattagcagagttaacttcaaagaattgcaacagataattaaaatgggacttgttcaaggtaacttaattccggcttttgcgggcgcatggctagcagttgtaatgacaaatcattccttcttatcatcaatacctcaaattttattaatgctatttggatctactttaattatgggtggcgcatgtgcgttaaataattattacgaccaagatattgatcgtattatgcctagtaaacaaaatagaccaactgtaaataatagaattacagatcaaaatttattactattaagttttggtatgatgttagttggagaaatttgtttgtttttattgaatataccatcaggcgtacttggtcttatggggattgtaggttatgtgtcttattactcaatatggtctaaaagacatacaacatggaacacagtgattgggagttttcctggagcagtaccaccactaattggatgggttgcaattgaaggacaaattagtttaacagcgattgcgctgtttttagttgtattttgttggcaaccaattcatttttatgccttagctattaaacgtaaagatgaatatgcacttgcaaatattccaatgttaccatcagttaagggctttaaacgtacacgtgtcagtatgtttatctggttgattattttattgccagtacctttattactaataaatttaggtgtcgtattcgtagtgttagctaccttattaaatttaggatggattgcattaggtttaacaacatttaagaaaaattcagatcaaacaaaatgggcaacacaaatgtttatatattcactaaattatttagtgatctttttcgtgttagctgtgattgtttcattacttactttgatc

SEQ ID NO: 4974 - protein, 303 aa, Staphylococcus aureus
  MISC_FEATURE (1)..(303): cytochrome caa3 oxidase
MSKEHTLSQNISRVNFKELQQIIKMGLVQGNLIPAFAGAWLAVVMTNHSFLSSIPQILLMLFGSTLIMGGACALNNYYDQDIDRIMPSKQNRPTVNNRITDQNLLLLSFGMMLVGEICLFLLNIPSGVLGLMGIVGYVSYYSIWSKRHTTWNTVIGSFPGAVPPLIGWVAIEGQISLTAIALFLVVFCWQPIHFYALAIKRKDEYALANIPMLPSVKGFKRTRVSMFIWLIILLPVPLLLINLGVVFVVLATLLNLGWIALGLTTFKKNSDQTKWATQMFIYSLNYLVIFFVLAVIVSLLTLI

SEQ ID NO: 4975 - DNA, 1068 bp, Staphylococcus aureus
atgtcgtccacatacaatacttgtaaaattaaatcatatttcctgcgttggatcccatcttttcatatcctacaatcaggtctatttatagtatcatctcaaatccggctattaattctaattctcagtgatgcgtttttttatgatggggtgtataaattgtttggcaaaaagaatttaaaatggttaggtgtcgtagcaacgttaatgatgacatttgtacaacttggtggagccttagttaccaaaaccggatcagctgatggttgtggttcttcttggccactatgtcatggtgcgttgattccagaattctttcctattgatacgattattgagttaagtcatagagccgtttcagctttgtctttattaatggtcttatggttagttatcactgcatggaaacatataggctatattaaagaaattaaacctttatcaatcattagtgttggattcttattattgcaagcattaatcggagctgctgctgttatttggcaacaaaacgattacgttttagcattgcactttggtatatcattaatcagtttctcatctgtatttttaataacattgattattttctctatagatcaaaaatatgaagctgacgaattatatatcaaaaagccattaagacgtttaacatggttaatggcaatcatcatttattgtggtgtttatactggtgcactagtgagacatgcggatgcaagtttagcatatggtggttggccattgccattccacgatcttgtaccacattcagaacaagattgggttcaactcacgcatcgtatcatggcttttatagtgtttacgattattatgattacttatattcacgctgttaaaaattatccaaataaccgtactgttcattatggttatacagctgcatttatacttgttatattacaagttatcacaggtgcattatctattatgacaaatgttaacctgataatcgcacttttccatgcattatttatcacttatttatttggtatgacaacatactttatcatgctaatgttacgatcagtaagaagtgacaagcaa

SEQ ID NO: 4976 - protein, 356 aa, Staphylococcus aureus
  MISC_FEATURE (1)..(356): hypothetical protein
MSSTYNTCKIKSYFLRWIPSFHILQSGLFIVSSQIRLLILILSDAFFYDGVYKLFGKKNLKWLGVVATLMMTFVQLGGALVTKTGSADGCGSSWPLCHGALIPEFFPIDTIIELSHRAVSALSLLMVLWLVITAWKHIGYIKEIKPLSIISVGFLLLQALIGAAAVIWQQNDYVLALHFGISLISFSSVFLITLIIFSIDQKYEADELYIKKPLRRLTWLMAIIIYCGVYTGALVRHADASLAYGGWPLPFHDLVPHSEQDWVQLTHRIMAFIVFTIIMITYIHAVKNYPNNRTVHYGYTAAFILVILQVITGALSIMTNVNLIIALFHALFITYLFGMTTYFIMLMLRSVRSDKQ

SEQ ID NO: 4977 - DNA, 3468 bp, Staphylococcus aureus
ttgaggagtgtatcgctattgaaacaaataaaaaagttacttgttgctaaccgtggagaaattgcaattcgtatattcagagcggcggcagaattagacatcagcacagttgcaatttattcgaatgaagacaaaagttcattacatagatataaagcagatgaatcctatttagttggaagtgatttaggtcctgctgaaagttatttaaatattgagcgtatcattgatgtagcaaaacaagcgaatgtggatgcgattcatcctggctatggatttttaagtgaaaatgaacaatttgcgcgtcgttgtgcagaagaaggaattaaatttattggtcctcatttagaacatttagatatgtttggagataaagttaaagctcgtacaacggctatcaaggcagatttaccagttattcctggtacagacggtccaattaaatcatatgaattagcaaaagaatttgcagaagaagctggtttcccgctaatgattaaagccacaagtggtggcggcggtaaaggtatgagaatcgttcgtgaagaaagtgaattagaagatgctttccatagagcaaaatcagaagctgaaaaatcatttggtaatagtgaagtttacatagaaagatacattgataatccaaagcatattgaagtacaagtcataggtgacgaacatggaaatatcgtacacttatttgaacgtgattgttcagtacaacgtcgtcatcaaaaagttgtagaagttgcaccatcagttggattatcatcaacattacgtcaacgtatttgtgatgctgcaattcaattgatggaaaatattaaatatgtcaatgcaggtactgttgaatttctagtatctggtgacgaattcttctttatagaagttaaccctcgtgtacaagtagagcatacaattacagagatggtaacaggaattgatattgttaagacacaaattttagttgcagcaggtgccgatttatttggtgaagagattaatatgccgcaacaaaaagatattacaacattaggctatgccatccaatgtcgtattacaacagaagatccgttaaatgatttcatgccggatactggaacaatcattgcttatcgttcaagcgggggctttggtgtacgtcttgatgctggagatggtttccaaggtgctgagatatcaccttattatgattcattactcgtaaaattatctacacacgcgatatcatttaaacaagcagaagaaaaaatggtacgctcattacgagaaatgcgtattcgtggtgttaaaactaatattccattcttaattaatgtaatgaagaataaaaagttcacaagtggtgattacacaactaaatttattgaagaaacaccagaacttttcgacattcagccgtctctagatagaggtactaaaacattagaatatataggtaatgtaacaattaatggtttcccaaatgttgagaaacgtccgaaaccagactatgaattagcatcaattccaactgtatcttcaagtaaaatcgcttcatttagtggtacgaaacaattgcttgatgaagtaggtccaaaaggtgtagctgaatgggttaaaaagcaggatgatgtcttactaacagatacaacctttagagatgcacaccaatcattattagctacacgagttagaactaaggatatgattaatatcgcatccaaaacagcggacgtatttaaagatggtttctcactagaaatgtggggcggtgctacatttgatgtggcatataatttcttgaaggaaaacccatgggaacgacttgaacgtctacgtaaagctattccaaatgtattattccaaatgttgttacgtgcttcaaacgcagttggttataaaaactatcctgataatgttattcataaattcgtacaagaaagtgctaaagcaggcatagatgtctttagaattttcgattcattaaactgggtagatcaaatgaaagttgccaatgaagcagtacaagaagcgggcaaaatctcagaaggtactatttgttatacaggtgacattttaaatcctgagcgatcaaacatttatactttagagtattatgtcaaactagctaaagagttagaacgtgaaggtttccatattttagcgattaaagatatggcaggcttattaaaacctaaagccgcttacgaattgattggtgagttaaaatcagctgtagatttaccaattcatcttcacactcatgatacaagtggtaatggtttattaacatacaaacaagcaatagatgctggtgtcgatatcattgatactgctgttgcttcaatgagtggtttaacaagtcagccaagcgccaattcgttatattatgcattaaatggcttcccacgccaccttagaactgatattgaaggtatggagtcacttagtcattattggtcaactgtacgtacttattattcagactttgaaagtgatatcaaatcaccgaatactgaaatttatcaacatgaaatgcctggtggacagtattcgaatttaagtcaacaagctaaaagtttaggtttaggcgaaagatttgatgaagtcaaagatatgtatcgcagagtgaatttcttatttggtgatatcgtaaaagtaacaccatcgtctaaagtagttggtgatatggcactttatatggtacaaaatgatcttgatgaacaatccgtgattacagatggctataaattagatttcccagaatcagtagtgtcgttcttcaaaggtgaaataggacaacctgtaaatggttttaataaagatttacaagcggttattttaaaaggccaagaagcactaacagctcgtccaggtgaatatctagagccagttgattttgaaaaagtccgtgagttgcttgaagaagagcaacaaggtcctgttacggagcaagatattattagttatgtactatatccaaaagtatatgaacaatatattcaaactagaaatcaatacggaaacttatcgttacttgatacgcctacattcttctttggaatgcgtaatggtgaaacagtagaaatcgaaatcgataaaggtaaacgattaattattaaactagaaacgattagtgaaccagatgaaaatggtaatagaacgatttactatgcgatgaatggtcaagcgagacgtatttacattaaagatgaaaatgtgcatacaaatgcgaacgttaagccaaaagcagataagagtaatccaagtcatatcggtgctcaaatgccaggttcagtaactgaagtcaaggttagtgtaggtgaaactgtgaaagctaatcagccgttgctaattactgaagctatgaaaatggaaacaacaattcaagcaccatttgacggtgtgattaaacaagtaactgtaaataatggtgacacaatagcgacaggcgatttattaatcgaaattgaaaaagcaactgac

SEQ ID NO: 4978 - protein, 1156 aa, Staphylococcus aureus
  MISC_FEATURE (1)..(1156): pyruvate carboxylase
LRSVSLLKQIKKLLVANRGEIAIRIFRAAAELDISTVAIYSNEDKSSLHRYKADESYLVGSDLGPAESYLNIERIIDVAKQANVDAIHPGYGFLSENEQFARRCAEEGIKFIGPHLEHLDMFGDKVKARTTAIKADLPVIPGTDGPIKSYELAKEFAEEAGFPLMIKATSGGGGKGMRIVREESELEDAFHRAKSEAEKSFGNSEVYIERYIDNPKHIEVQVIGDEHGNIVHLFERDCSVQRRHQKVVEVAPSVGLSSTLRQRICDAAIQLMENIKYVNAGTVEFLVSGDEFFFIEVNPRVQVEHTITEMVTGIDIVKTQILVAAGADLFGEEINMPQQKDITTLGYAIQCRITTEDPLNDFMPDTGTIIAYRSSGGFGVRLDAGDGFQGAEISPYYDSLLVKLSTHAISFKQAEEKMVRSLREMRIRGVKTNIPFLINVMKNKKFTSGDYTTKFIEETPELFDIQPSLDRGTKTLEYIGNVTINGFPNVEKRPKPDYELASIPTVSSSKIASFSGTKQLLDEVGPKGVAEWVKKQDDVLLTDTTFRDAHQSLLATRVRTKDMINIASKTADVFKDGFSLEMWGGATFDVAYNFLKENPWERLERLRKAIPNVLFQMLLRASNAVGYKNYPDNVIHKFVQESAKAGIDVFRIFDSLNWVDQMKVANEAVQEAGKISEGTICYTGDILNPERSNIYTLEYYVKLAKELEREGFHILAIKDMAGLLKPKAAYELIGELKSAVDLPIHLHTHDTSGNGLLTYKQAIDAGVDIIDTAVASMSGLTSQPSANSLYYALNGFPRHLRTDIEGMESLSHYWSTVRTYYSDFESDIKSPNTEIYQHEMPGGQYSNLSQQAKSLGLGERFDEVKDMYRRVNFLFGDIVKVTPSSKVVGDMALYMVQNDLDEQSVITDGYKLDFPESVVSFFKGEIGQPVNGFNKDLQAVILKGQEALTARPGEYLEPVDFEKVRELLEEEQQGPVTEQDIISYVLYPKVYEQYIQTRNQYGNLSLLDTPTFFFGMRNGETVEIEIDKGKRLIIKLETISEPDENGNRTIYYAMNGQARRIYIKDENVHTNANVKPKADKSNPSHIGAQMPGSVTEVKVSVGETVKANQPLLITEAMKMETTIQAPFDGVIKQVTVNNGDTIATGDLLIEIEKATD

SEQ ID NO: 4979 - DNA, 2058 bp, Staphylococcus aureus
ttggctaaagtaaacttaatagaaagtccatattctcttttacaattaaaaggtataggtcctaagaaaatagaagtattgcaacaactaaatattcatacagtggaagatcttgttctttatttgccaactagatatgaagataatacagtgattgatttgaatcaagcagaagatcaatctaacgttacgatagaaggacaagtatatacagctccagtagttgcattttttggaagaaataaatcaaaattaaccgttcatttaatggtaaataatattgctgtcaaatgtatttttttcaatcaaccgtatttaaaaaagaaaatcgaattaaatcaaactataactgttaaaggtaagtggaatagggttaaacaggaaattactggtaatagggttttctttaattcacaagggacacaaactcaagaaaacgcagatgttcaattagaaccagtctatcgtattaaggaaggtattaaacaaaagcaaatacgagaccaaattagacaagcgttaaatgatgtgacaattcatgaatggttaactgatgaactaagagaaaaatataaattagagaccttggactttactttgaacacattacatcatcctaaaagtaaagaggatttattacgtgctcgtagaacctatgcatttactgaactgtttttattcgaattacgtatgcaatggctaaatagattagaaaagtcatctgacgaagcaattgaaattgattatgacatagaccaagttaaatcatttattgatcgtttaccttttgaactaactgaagcacagaaatccagtgttaatgaaatttttagagatttaaaagcaccaatacgtatgcatcgattacttcaaggtgatgtaggttcaggaaaaacagtagttgctgcaatttgtatgtatgcgttaaaaactgctggttatcaatcagcattgatggtaccaactgaaattttagcagagcaacatgctgaaagtttaatggctttatttggagattctatgaacgttgcattgttaactgggtcagtaaaaggtaagaaacgaaagatacttttagaacaacttgaaaatggtacgattgattgtttaattggaacccatgctttgattcaagatgatgtgattttccataatgttggtttagtaattacagatgaacaacatcgatttggtgtgaatcaacgccagcttttaagagaaaaaggtgcaatgacgaatgtgttatttatgacagcaacgccgataccaagaacactagcaatatcagtttttggtgagatggatgtgtcttcaattaaacaattaccaaaaggtcgtaaacctatcattactacttgggcaaagcatgagcaatacgataaagttttgatgcaaatgacctcagagttgaaaaaaggtcgtcaagcatatgtcatttgcccgctaatagaaagttctgagcatctcgaagatgttcaaaatgttgtcgcattgtacgagtctttacaacagtattatggtgtttcccgtgtagggttattgcatggtaagttatctgccgatgaaaaagatgaggtcatgcaaaagtttagtaatcatgagataaatgttttagtttctactactgttgttgaagtaggtgttaatgtaccgaatgcaacttttatgatgatttatgatgcggatcgctttggattatcaactttacatcagttacgcggtcgtgtaggtagaagtgaccagcaaagttactgtgttttaattgcatcccctaaaacagaaacaggaattgaaagaatgacaattatgacacaaacaacggatggatttgaattgagtgaacgagacttagaaatgcgtggtcctggagatttctttggtgttaaacaaagtggattgccagatttcttagttgccaatttagttgaagattatcgtatgttagaagttgctcgtgatgaagcagctgaacttattcaatctggcgtattctttgaaaatacgtatcaacatttacgtcattttgttgaagaaaatttattacatcgtagttttgac

SEQ ID NO: 4980 - protein, 686 aa, Staphylococcus aureus
  MISC_FEATURE (1)..(686): ATP-dependent DNA helicase
LAKVNLIESPYSLLQLKGIGPKKIEVLQQLNIHTVEDLVLYLPTRYEDNTVIDLNQAEDQSNVTIEGQVYTAPVVAFFGRNKSKLTVHLMVNNIAVKCIFFNQPYLKKKIELNQTITVKGKWNRVKQEITGNRVFFNSQGTQTQENADVQLEPVYRIKEGIKQKQIRDQIRQALNDVTIHEWLTDELREKYKLETLDFTLNTLHHPKSKEDLLRARRTYAFTELFLFELRMQWLNRLEKSSDEAIEIDYDIDQVKSFIDRLPFELTEAQKSSVNEIFRDLKAPIRMHRLLQGDVGSGKTVVAAICMYALKTAGYQSALMVPTEILAEQHAESLMALFGDSMNVALLTGSVKGKKRKILLEQLENGTIDCLIGTHALIQDDVIFHNVGLVITDEQHRFGVNQRQLLREKGAMTNVLFMTATPIPRTLAISVFGEMDVSSIKQLPKGRKPIITTWAKHEQYDKVLMQMTSELKKGRQAYVICPLIESSEHLEDVQNVVALYESLQQYYGVSRVGLLHGKLSADEKDEVMQKFSNHEINVLVSTTVVEVGVNVPNATFMMIYDADRFGLSTLHQLRGRVGRSDQQSYCVLIASPKTETGIERMTIMTQTTDGFELSERDLEMRGPGDFFGVKQSGLPDFLVANLVEDYRMLEVARDEAAELIQSGVFFENTYQHLRHFVEENLLHRSFD

SEQ ID NO: 4981 - DNA, 1236 bp, Staphylococcus aureus
atgactgaatatatgaagaattttagaagtattttacggtatattggtaaaacctcaaagtttattgattatccgttattagttacatatattgtattgagtttaattggattagtgatggtatatagtgcaagtatggttccagcaactaaaggcacattgactggtggtatcgatgttccaggaacgtatttttacaaccgacaattagcatatgtcataatgagttttataattgtattttttattgcatttttaatgaatgttaaattactgagtaatattaaagtgcaaaaaggtatgattataactatcgtctcactattattactgacgttagtaataggtaaagatattaatggttctaaaagttggataaacttaggatttatgaacttacaggcatctgagttattaaaaattgcaatcatattatatatcccatttatgatcagtaaaaaaatgcctagagtattaagtaaaccaaaattaattttaagtcctattgtattagcattaggttgtacgtttttagttttcctacaaaaagacgtagggcaaacattactaatattaattattttagttgcgatcattttttattcaggaattggggtaaacaaagtcctaagatttggtataccagcagtgctaggattcttagtagtatttgtcattgcattaatggctggttggttaccaagttatttaactgccagatttagtacgctaacagatccattccaattcgaatcaggaactggataccatatttccaattcattgcttgcgataggtaacggtggcgtatttggaaaaggattaggaaatagtgcaatgaaattgggctatttaccagaaccacatacagattttatttttgcaattatttgcgaagaattaggtttaatcggaggattgctagttattactttagagttctttattgtatatcgtgccttccagtttgcaaataaaacatcatcatatttttataaacttgtgtgtgttgggattgccacatactttggaagtcaaacgtttgtaaacattggcggtatttcggcaacaattccattaactggtgtgccattgccatttatcagctttggtggatcatcaatgattagtttaagtattgctatgggtttacttctgattgtaggtaaacaaatcaaagtagaccagcaacgaaagaaacaacaacaaaaagttgatataagaagacaatttaat

SEQ ID NO: 4982 - protein, 412 aa, Staphylococcus aureus
  MISC_FEATURE (1)..(412): conserved hypothetical
MTEYMKNFRSILRYIGKTSKFIDYPLLVTYIVLSLIGLVMVYSASMVPATKGTLTGGIDVPGTYFYNRQLAYVIMSFIIVFFIAFLMNVKLLSNIKVQKGMIITIVSLLLLTLVIGKDINGSKSWINLGFMNLQASELLKIAIILYIPFMISKKMPRVLSKPKLILSPIVLALGCTFLVFLQKDVGQTLLILIILVAIIFYSGIGVNKVLRFGIPAVLGFLVVFVIALMAGWLPSYLTARFSTLTDPFQFESGTGYHISNSLLAIGNGGVFGKGLGNSAMKLGYLPEPHTDFIFAIICEELGLIGGLLVITLEFFIVYRAFQFANKTSSYFYKLVCVGIATYFGSQTFVNIGGISATIPLTGVPLPFISFGGSSMISLSIAMGLLLIVGKQIKVDQQRKKQQQKVDIRRQFN

SEQ ID NO: 4983 - DNA, 303 bp, Staphylococcus aureus
ttgagaatttatatagagggggagcgtgtcatggcgaaacaagcaacaatgaaaaatgcagctttgaaacaattgactaaagatgctgatgaaatcttgcatctgattaaagttcaactagataatttaacattaccttcatgcccattatatgaagaagtactagatacacaaatgtttggacttcaaaaagaagttgattttgctgttaaattaggtttagttgaccgcgaagatggcaaacaaattatgttacgtcttgagaaagaactttcaaaattacatgaagcttttacacttgtt

SEQ ID NO: 4984 - protein, 101 aa, Staphylococcus aureus
  MISC_FEATURE (1)..(101): conserved hypothetical
LRIYIEGERVMAKQATMKNAALKQLTKDADEILHLIKVQLDNLTLPSCPLYEEVLDTQMFGLQKEVDFAVKLGLVDREDGKQIMLRLEKELSKLHEAFTLV

SEQ ID NO: 4985 - DNA, 537 bp, Staphylococcus aureus
gtgtcgttagcaatttgtgttaaaataatgctatatacattgatagggagtgggaaaatgatacaaattaaaggagccgtaaagtttcctataacattagatagtacgacttggattttcgatgatagaaaagttagcatcgaagatttagaaaaaggtgtatttgatggttcaaaaccaatcgactttgaagataatcatgaatggaatcgtgctatcctagaaggacaaactaatccgcctactttaaattcagaaataaaatataaaaaacgtgccatgttagaaggttcatttgtcattaatatgacaccatttttcaaacattccgaaccacatgactctgcaactactattcgattatcaaatgagcatgatcatttagatataccgatagatctattaccctatttatttttccaatttgcaaaagacggtaaacgactttacagcgataatggtgtagatagttttatttacaatcaagaagatggttattcatatcgaatcaaccatgtaactcatattgaggtgatt

SEQ ID NO: 4986 - protein, 179 aa, Staphylococcus aureus
  MISC_FEATURE (1)..(179): conserved hypothetical
VSLAICVKIMLYTLIGSGKMIQIKGAVKFPITLDSTTWIFDDRKVSIEDLEKGVFDGSKPIDFEDNHEWNRAILEGQTNPPTLNSEIKYKKRAMLEGSFVINMTPFFKHSEPHDSATTIRLSNEHDHLDIPIDLLPYLFFQFAKDGKRLYSDNGVDSFIYNQEDGYSYRINHVTHIEVI

SEQ ID NO: 4987 - DNA, 165 bp, Staphylococcus aureus
ttgagacaagtgcaatgcattatctgtgatgcaaaagtatttatagatgagcgcacaactgagtctaaacgacttaaaaacaatcctattcgaacatttatgtgtgatgattgtaaaagtcgattagacacacctaaacaacgtgcgcaacactatccgctcgat

SEQ ID NO: 4988 - protein, 55 aa, Staphylococcus aureus
  MISC_FEATURE (1)..(55): conserved hypothetical
LRQVQCIICDAKVFIDERTTESKRLKNNPIRTFMCDDCKSRLDTPKQRAQHYPLD

SEQ ID NO: 4989 - DNA, 1881 bp, Staphylococcus aureus
gtgggattttacttaagaaagaaggaaactatttatatgactaataaaagagaagatgtccgcaatatagcaattattgctcacgttgaccatggtaaaacaactttagtagatgagttgttaaaacaatctggtatattcagagaaaatgaacatgtcgatgaacgtgcaatggactctaacgatatcgaaagagagcgtggaattacgattctagccaaaaatacggctgttgattataaaggtacacgtattaatattttggatacaccaggacatgcagactttggtggagaagtagaacgtattatgaaaatggttgatggggttgtcttagtagtagatgcgtatgaaggtacaatgcctcaaacacgttttgtacttaaaaaagcgctagaacaaaacctgaaacctgttgttgttgttaataaaattgataaaccatcagcacgtccagagggtgttgtagatgaagttttagatttatttattgaattagaagcaaacgatgaacaattagaattccctgttgtttatgcttcagcagtaaatggtacagctagcttagatcctgaaaagcaagatgataatttacaatcattatatgaaacaattattgattatgtaccagctccaattgataacagtgatgagccattacaattccaagtagcattgttggactacaatgattatgttggacgtattggtattggtcgtgtattcagaggtaaaatgcgtgtcggagataatgtatcactaattaaattagacggtacagtgaaaaacttccgtgtaactaaaatctttggttactttggattaaaacgtttagaaattgaagaagcacaagctggagatttaattgctgtttcaggtatggaagacattaatgttggtgaaactgtaacaccacatgaccatcaagaagcattgccagttctacgtattgatgagcctactcttgaaatgacatttaaagttaacaattctccatttgctggccgtgaaggtgactttgtaacagcacgtcaaattcaagaacgtttaaatcaacaattagaaacagatgtatctttgaaagtttctaacacagattctccagatacatgggtagttgctggtcgcggtgaattgcatttatcaatccttattgaaaatatgcgtcgtgaaggttatgaattacaagtttcaaaaccacaagtaattattaaagaaatagatggtgtaatgtgtgaaccatttgaacgtgtgcaatgtgaagtgccacaagaaaatgcaggtgctgttattgaatcattaggtgcacgtaaaggtgaaatggttgatatgactacaactgataatggacttacacgtttaatctttaatgtaccggctcgtggtatgattggttatacgactgaatttatgtcaatgacaagaggttacggtattattaaccatacatttgaagaatttagaccacgtattaaagcacaaattggcggtcgtcgtaatggtgcattaatttcaatggatcaaggttctgcaagtacttatgccattttgggacttgaagatagaggtgtaaacttcatggaacctggtactgaagtttatgaaggtatgattgttggtgaacataatcgtgaaaatgatttaactgttaacatcactaaaacaaaacatcaaactaacgtacgttctgcaacgaaagaccaaacacaaacaatgaatagaccgcgtattctaacattggaagaagcgttacaattcattaatgatgatgaacttgttgaggttacaccagaaagtatacgtttaagaaagaaaattttaaacaaaaatgttcgtgaaaaagaagcaaagcgtatcaaacaaatgatgcaagaaaacgaa

SEQ ID NO: 4990 - protein, 627 aa, Staphylococcus aureus
  MISC_FEATURE (1)..(627): GTP-binding elongation
VGFYLRKKETIYMTNKREDVRNIAIIAHVDHGKTTLVDELLKQSGIFRENEHVDERAMDSNDIERERGITILAKNTAVDYKGTRINILDTPGHADFGGEVERIMKMVDGVVLVVDAYEGTMPQTRFVLKKALEQNLKPVVVVNKIDKPSARPEGVVDEVLDLFIELEANDEQLEFPVVYASAVNGTASLDPEKQDDNLQSLYETIIDYVPAPIDNSDEPLQFQVALLDYNDYVGRIGIGRVFRGKMRVGDNVSLIKLDGTVKNFRVTKIFGYFGLKRLEIEEAQAGDLIAVSGMEDINVGETVTPHDHQEALPVLRIDEPTLEMTFKVNNSPFAGREGDFVTARQIQERLNQQLETDVSLKVSNTDSPDTWVVAGRGELHLSILIENMRREGYELQVSKPQVIIKEIDGVMCEPFERVQCEVPQENAGAVIESLGARKGEMVDMTTTDNGLTRLIFNVPARGMIGYTTEFMSMTRGYGIINHTFEEFRPRIKAQIGGRRNGALISMDQGSASTYAILGLEDRGVNFMEPGTEVYEGMIVGEHNRENDLTVNITKTKHQTNVRSATKDQTQTMNRPRILTLEEALQFINDDELVEVTPESIRLRKKILNKNVREKEAKRIKQMMQENE

SEQ ID NO: 4991 - DNA, 189 bp, Staphylococcus aureus
atgaaacaaaaaaaatctaaaaatatcttttgggtattttctatattagctgttgttttcttagtattatttagttttgctgttggtgcatcaaatgtaccaatgatgattttaacatttatattactcgttgcaacctttggaattggatttactacaaagaaaaaatatcgagaaaacgattggcta

SEQ ID NO: 4992 - protein, 63 aa, Staphylococcus aureus
  MISC_FEATURE (1)..(63): hypothetical protein
MKQKKSKNIFWVFSILAVVFLVLFSFAVGASNVPMMILTFILLVATFGIGFTTKKKYRENDWL

SEQ ID NO: 4993 - DNA, 843 bp, Staphylococcus aureus
atgttaggagatgatgttatggcactttatggatttgcccaaggacttattcaagaagcaggaattagaattaaacaattgatggagcaaaatttaacaattgaaacaaagtcaaatccgaatgaccttgttacaaatgtagataaagcaacagaagatttcatttttgatacaattttagaaacatatcccaatcatcaagtattaggtgaagaagggcatggtcatgacatcgatacttccaaaggtacggtatggattgttgacccaatagacggtacattgaattttgttcatcaacaagaaaatttcgcaatttcaattggtatttatatcgatggtaaaccttatgcaggttttgtatatgatgttatggctgatgtcttatatcatgctaaagtaggggaaggtgcatatcgtggtagccaacccttgaaaccattgaatgattctaatctaagacaaagcattattgggatcaatccgaactggttaactaaaccaattttaggagaaatctttaaagaaattgttaatgattctagaagtgcaagggcatatggtagtgcagcgcttgaaatcgtttcagttgctacaggtaatttagaagcatatatgacgccaagacttcaaccatgggattttgctggcggattggttattttatatgaagtaaatggacaagcttccaatttactaggagaaccattaacaattagtggtccaaattcaatcttagttggaaatcgtggtctccatcaagaaattagcaatgattatttagagccccaccatgatgcgttaatacaattacatgaacaacgatttaaaagaaaatcaaaa

SEQ ID NO: 4994 - protein, 281 aa, Staphylococcus aureus
  MISC_FEATURE (1)..(281): myo-inositol-1(or
MLGDDVMALYGFAQGLIQEAGIRIKQLMEQNLTIETKSNPNDLVTNVDKATEDFIFDTILETYPNHQVLGEEGHGHDIDTSKGTVWIVDPIDGTLNFVHQQENFAISIGIYIDGKPYAGFVYDVMADVLYHAKVGEGAYRGSQPLKPLNDSNLRQSIIGINPNWLTKPILGEIFKEIVNDSRSARAYGSAALEIVSVATGNLEAYMTPRLQPWDFAGGLVILYEVNGQASNLLGEPLTISGPNSILVGNRGLHQEISNDYLEPHHDALIQLHEQRFKRKSK

SEQ ID NO: 4995 - DNA, 612 bp, Staphylococcus aureus
atgacaaaatatacatttaaacctaaagatttcaaagcgttcaacgtagaaggcttagacgcacgaatggaagctttaaacgaatacatacgaccacaactccgtgaattaggagaatattttagtgacttctttacaagtcaaactggtgaaacattttatcctcacgtagcaaagcatgctagaagaagtgtgaatcctcctaaagatacatgggttgcttttgcaacaaacaaaagaggctataaaatgttacctcatttccaaattggtatgtttgaagatcaactgtttgttatgtttggaatcatgcatgaagcaaaagataaagcaacacgtgcaaaagtttttgaaagaaaatttaaagctattcaacaattacctgatgattatcgtgtttgcttagatcatatgaaacctgataaaccatttattaaagatttaacggatgatgatttaatagaagcgatacaaagagccatcaatgtgaaaaaaggtgaattctttatagcgcgtgcaatcacaccacaagataaaagattaaaaagtgacaaagcatttattgcatttttagaagaaaccttcgatcagttcttaccattttattctgca

SEQ ID NO: 4996 - protein, 204 aa, Staphylococcus aureus
  MISC_FEATURE (1)..(204): conserved hypothetical
MTKYTFKPKDFKAFNVEGLDARMEALNEYIRPQLRELGEYFSDFFTSQTGETFYPHVAKHARRSVNPPKDTWVAFATNKRGYKMLPHFQIGMFEDQLFVMFGIMHEAKDKATRAKVFERKFKAIQQLPDDYRVCLDHMKPDKPFIKDLTDDDLIEAIQRAINVKKGEFFIARAITPQDKRLKSDKAFIAFLEETFDQFLPFYSA

SEQ ID NO: 4997 - DNA, 1350 bp, Staphylococcus aureus
atgaataataaacgacattcaacaaatgaacaattaagtttagacgaaataaacaatacaattaaattcgatcatcgcagttcaaataaacagaaatttttatcatttcttggacctgggttattagtcgctgttggttacatggatcccggaaactggataacatcaatgcaaggtggcgcccaatatggctatactttgctattcgtaattcttatttcaagtttatcagcaatgttacttcaaagcatgacagtgagattaggaatagcaacaggtatggacttagctcaaatgacacgacattatttatcaagacctattgctataatcttttggatcattgcagaactagcaattatcgctacagatattgctgaggttattggtagtgctattgctcttaatctcctatttaacatacctttaatcgtcggtgcactaataactgtacttgatgtatttttactactttttataatgaaatatggttttagaaaaattgaagctattgttggtacattaattttcacagtgttattcatctttatatttgaagtctatatttcatcaccacagttgaatgctgtgttaaatggatttataccacatagtgaaatcattacaaataacggcattctctatattgcattaggtattattggcgctacaattatgcctcataatttgtacttacattcatcaattgtacaatctagaacatactcaagacataacaatgaagaaaaagcgcaagcgattaaatttgctacgatagattcgaacattcagttatcaatcgcatttgtagtcaattgcttattattagtgttaggagcatcactatttttcaactcaaatgctgacgatttaggtggtttctatgatttatatcacgccttaaaaactgaacctgtactaggtgcaacaatgggtgcaatcatgagtacattatttgcagttgcattattagcgtcaggtcaaaattcaacgattactggtactttagcaggacaaattgtaatggaaggatttttaagattacacataccaaattggttaagacgtttaattacacgttctcttgctgtcattcctgttatcgtatgcttaatcatttttaaaggtaatgcagctaaaattgagcaactacttgtattctctcaagtatttttaagtattgctctgccattctgtttaataccattacaattggctactagtaataaagacttgatgggacctttctataataaaacatgggttaatatcatttcatggacacttattattattctaagtattttaaatgtctatttaatcgttcaaacattccaagaactacaaagt

SEQ ID NO: 4998 - protein, 450 aa, Staphylococcus aureus
  MISC_FEATURE (1)..(450): hypothetical protein
MNNKRHSTNEQLSLDEINNTIKFDHRSSNKQKFLSFLGPGLLVAVGYMDPGNWITSMQGGAQYGYTLLFVILISSLSAMLLQSMTVRLGIATGMDLAQMTRHYLSRPIAIIFWIIAELAIIATDIAEVIGSAIALNLLFNIPLIVGALITVLDVFLLLFIMKYGFRKIEAIVGTLIFTVLFIFIFEVYISSPQLNAVLNGFIPHSEIITNNGILYIALGIIGATIMPHNLYLHSSIVQSRTYSRHNNEEKAQAIKFATIDSNIQLSIAFVVNCLLLVLGASLFFNSNADDLGGFYDLYHALKTEPVLGATMGAIMSTLFAVALLASGQNSTITGTLAGQIVMEGFLRLHIPNWLRRLITRSLAVIPVIVCLIIFKGNAAKIEQLLVFSQVFLSIALPFCLIPLQLATSNKDLMGPFYNKTWVNIISWTLIIILSILNVYLIVQTFQELQS

SEQ ID NO: 4999 - DNA, 1683 bp, Staphylococcus aureus
gtgaataatacaggcaagaagcttagaggacaacttgaaatgattagcaaaattaatggtaaattatttgccgatatgattatacaaggggcacaaaatttatctaacaatgcagatttggtagattctttgaatgtgtatccagtgccagatggtgatacaggaacaaatatgaatcttactatgacttcaggtcgcgaagaagtagagaataatttgtcgaaaaatatcggcgaattaggtaaaacattctcgaaaggtttactaatgggtgcaagaggtaactctggtgtcatcttgtcacaattattcagaggattttgtaaaaatattgaaagtgaatctgaaattaattcaaaattgttagctgaaagttttcaagctggtgttgaaacggcatataaagctgttatgaaaccagttgaaggtacaatacttacagttgcaaaagatgctgcgcaagctgcaatagaaaaagcaaataatactgaagattgtatagaattaatggagtacattattgtaaaagccaatgaatcacttgaaaacacaccaaacttattagctgtacttaaagaagttggtgttgttgatagtggcggtaaaggtttgttatgcgtttacgaaggattcttaaaagcgcttaaaggtgaaaaagttgaagccaaagttgcaaagatagataaagatgaatttgtacatgatgaacatgatttccatggtgtaattaatactgaagatattatttatggctattgtactgaaatgatggttcgttttggaaagaataaaaaagcctttgatgaacaagaattcaggcaagatatgagtcaatttggtgattctttattagtcattaatgatgaagaaattgtgaaagttcacgtgcataccgaatacccaggtaaagtgtttaattatggtcaacaatatggtgaattaattaaacttaaggttgaaaatatgagagaacagcaccgtgaagtgattcgaaaagaacagcacacagctaaaccgaaaatggaaacggttgaaacagcaattattactatttctatgggtgaaggtatttcagagatatttaaatcaatgggtgccacacatatcattagtggtggacaaacgatgaatccttctacagaagatatcgttaaagtcattgaacaatcaaaatgtaaacgtgcaattattttaccgaataataaaaatatcttaatggcaagtgaacaagcagcgagtattgttgatgcagaagctgttgttattccaacgaaatctattcctcaaggtataagcgcactattccaatatgatgtggacgcaacacttgaagaaaataaagcgcaaatggctgattcagtaaataacgttaaatctggttcattaacgtacgctgttcgtgatacgaaaattgatggcgttgagattaaaaaagacgcgtttatgggcttgattgaagataagattgtaagcagccaaagtgatcaattaacaacggttactgagttgttaaatgagatgttagcagaagatagtgaaatattgactgtgattattggtcaagatgcagagcaagcagttacagataacatgataaactggatcgaagagcaatatccagatgtagaagtggaagttcatgaaggtggacaaccaatttatcaatatttcttttcagtagaa

SEQ ID NO: 5000 - protein, 561 aa, Staphylococcus aureus
  MISC_FEATURE (1)..(561): conserved hypothetical
VNNTGKKLRGQLEMISKINGKLFADMIIQGAQNLSNNADLVDSLNVYPVPDGDTGTNMNLTMTSGREEVENNLSKNIGELGKTFSKGLLMGARGNSGVILSQLFRGFCKNIESESEINSKLLAESFQAGVETAYKAVMKPVEGTILTVAKDAAQAAIEKANNTEDCIELMEYIIVKANESLENTPNLLAVLKEVGVVDSGGKGLLCVYEGFLKALKGEKVEAKVAKIDKDEFVHDEHDFHGVINTEDIIYGYCTEMMVRFGKNKKAFDEQEFRQDMSQFGDSLLVINDEEIVKVHVHTEYPGKVFNYGQQYGELIKLKVENMREQHREVIRKEQHTAKPKMETVETAIITISMGEGISEIFKSMGATHIISGGQTMNPSTEDIVKVIEQSKCKRAIILPNNKNILMASEQAASIVDAEAVVIPTKSIPQGISALFQYDVDATLEENKAQMADSVNNVKSGSLTYAVRDTKIDGVEIKKDAFMGLIEDKIVSSQSDQLTTVTELLNEMLAEDSEILTVIIGQDAEQAVTDNMINWIEEQYPDVEVEVHEGGQPIYQYFFSVE

SEQ ID NO: 5001 - DNA, 582 bp, Staphylococcus aureus
  MISC_FEATURE (1)..(582): n = g, a, t, or c
gtgggtcaaaaaattaatccaatcggacttcgtgttggtattatccgtgattgggaagctaaatggtatgctgaaaaagacttcgcttcacttttacacgaagatttaaaaatccgtaaatttattgataatgaattaaaagaagcatcagtttctcacgtagagattgaacgtgctgcaaaccgtatcaacattgcaattcatactggtaaacctggtatggtaattggtaaaggcggttcagaaatcgaaaaattacgcaacaaattaaatgcgttaactgataaaaaagtacacatcaacgtaattgaaatcaaaaaagttgatcttgacgctcgtttagtagctgaaaacatcgcacgtcaattagaaaaccgtgcttcattccgtcgtgtacaaaaacaagccatcactagagctatgaaacttggtgctaaaggtatcaaaactcaagtatctggtcgtttaggcggagctgacatcgctcgtgctgaacaatattcagaaggaactggtccacttcatacgttacgtgctgacatcgattatgcacacgctgaagctgacactactnnnnntaaa

SEQ ID NO: 5002 - protein, 194 aa, Staphylococcus aureus
  MISC_FEATURE (1)..(194): Xaa = any amino acid
  MISC_FEATURE (1)..(194): 30S ribosomal protein S3
VGQKINPIGLRVGIIRDWEAKWYAEKDFASLLHEDLKIRKFIDNELKEASVSHVEIERAANRINIAIHTGKPGMVIGKGGSEIEKLRNKLNALTDKKVHINVIEIKKVDLDARLVAENIARQLENRASFRRVQKQAITRAMKLGAKGIKTQVSGRLGGADIARAEQYSEGTGPLHTLRADIDYAHAEADTTXXK

SEQ ID NO: 5003 - DNA, 417 bp, Staphylococcus aureus
atgaatagaaaacctgaattaatcatggcttggattgcaaatagtattagtattatttatttattagttatggggctatcctatttttctttaaaaagtggtaatgcatcacaacgtgaagaattagcgaagcaattatctcagaacggtggcaaggtttctttagatatgcttcagacaacaatgggtgcattagcaattattttattaatttcaacactttatggtatatttgcgacaatttgtattaaaggacgtagaaaattatcgattatactttttgttatcgcgataattgtaagtttgatggctcttaatttaattgcaattgtcttatgggttatcgtgatgattatgttgatttctaaaaaagaatcaaaagaaacaacacataaggacgatgagtatatttatcat

SEQ ID NO: 5004 - protein, 139 aa, Staphylococcus aureus
  MISC_FEATURE (1)..(139): hypothetical protein
MNRKPELIMAWIANSISIIYLLVMGLSYFSLKSGNASQREELAKQLSQNGGKVSLDMLQTTMGALAIILLISTLYGIFATICIKGRRKLSIILFVIAIIVSLMALNLIAIVLWVIVMIMLISKKESKETTHKDDEYIYH

SEQ ID NO: 5005 - DNA, 1017 bp, Staphylococcus aureus
atgactggagaacaatttactcaaattaaacgtccagtaagtagattaactgaaaaagttctaggttggttatgttgggtgatgttattagtgcttactgtcattacgatgtttatagcacttgtttcattcagtaataacacatcgattgctaatcttgaaaatacattaaacaataatgcatttatccagcaattattagctggaaatggctataatacaacacaatttgtaatatggttacaaaatggtatatgggctattatcgtttactttattgtttgtttgttgatttcatttttagctctcatatctatgaatataagaatcttgtcaggtttcttattcttaatatcagcaattgtaacgattcctttagttttacttatcgttactttaatcattccgatattattctttattattgcgatgatgctatttataagaaaagataaagttgaaatggttgcgccacaatattatgaagagtataacggaccgatttatgattatcgtgaacctgtgtatgagcgcccccaaccgaaagatgattattatgatgtgcctaaatatgaaaaagaattggataaatcaaatactgtatatgatcaagaacaggaaagagataaatatgatcaatttcctaaacgtgcagttgaaagtgaatataatcatgatgagcgcactgaggaagaaccatcagtattatccagacaggctaaatacaaacaaaaaagtactgaagaactaggtattgaagatgatggttattatgcagaacctgaagttgatccaaaagaattgaaagcacaacaaaagcgagaaaaagctgaaattaaagctaagaaaaaagaaaaacgtaaagcttataaccaacgaatgaaagaacgtaggaaaaatcaacctagcgcagttagtcaacgtcgaatgaattttgaagagcgacgtcaaatttacaacaatgatatttctgaagaacgcaattcaagtgaagttaaggacaaaaaagagcaagaa

SEQ ID NO: 5006 - protein, 339 aa, Staphylococcus aureus
  MISC_FEATURE (1)..(339): conserved hypothetical
MTGEQFTQIKRPVSRLTEKVLGWLCWVMLLVLTVITMFIALVSFSNNTSIANLENTLNNNAFIQQLLAGNGYNTTQFVIWLQNGIWAIIVYFIVCLLISFLALISMNIRILSGFLFLISAIVTIPLVLLIVTLIIPILFFIIAMMLFIRKDKVEMVAPQYYEEYNGPIYDYREPVYERPQPKDDYYDVPKYEKELDKSNTVYDQEQERDKYDQFPKRAVESEYNHDERTEEEPSVLSRQAKYKQKSTEELGIEDDGYYAEPEVDPKELKAQQKREKAEIKAKKKEKRKAYNQRMKERRKNQPSAVSQRRMNFEERRQIYNNDISEERNSSEVKDKKEQE

SEQ ID NO: 5007 - DNA, 1071 bp, Staphylococcus aureus
atgaaacgatttttacaactcattataggtgcattagttgtgggtatgctttgtcttactttaagtcattggtttaaatctaaagaacaagtgcatacaaatcaaaaaatttacgtatacaattggggcgaatatattgatccagagttaattaagaaatttgaaaaagaaactggcattcaagtcgtttatgaaactttcgattcaaatgaagcgatggaagccaaaattcgcaatggcggtacacattatgatgttgcttttcctagtgaatatacagttcaaaaattgaaaagagatcatttattgttaccaatagatcataataaggtacctaatattaaaaatttagattcagattatatgaatatgtcatttgatagaggcaataaatattctttaccttatttctttggaactgtaggtattttatataataaagaaaagtatccaaatgaatcatttgatagttggaagtcattgtataatcctaaatttaaaaaccaaattttactagttgacggtgctagagagattataggcatgagtttgaataaacttgggtataatcttaatgaccgtaattcgcaccatttaaaagaagcagagcgagatttaaccaaactagcaccacaagtaagaggtgtcgtaggtgatgaaattaccatgatgcttcaacaaaatgaaggtaacatagcggttgtttggagtggtgttgcagcacctctagtgcaagaaggggataaatataattatgttattcctaaagaaggatcgaatttatggttcgacaatatggtaattccaaaaacggcacaaaataaagagggtgcatataaatttatgaattttttattagatgctaaaaataacaagcaaaatacagaattcgtaggctatgcaacgccaaacaaggctgctcgacaattgttgcctaaagagattaaagacgaccatcgtttttatccgactaagaaagagcaagaacgccttgaagtttataaagatttaggacctgaagttttaagtgaatacaatgaaaactttttgaatttcaaaatgtcattaaaa

SEQ ID NO: 5008 - protein, 357 aa, Staphylococcus aureus
MKRFLQLIIGALVVGMLCLTLSHWFKSKEQVHTNQKIYVYNWGEYIDPELIKKFEKETGIQVVYETFDSNEAMEAKIRNGGTHYDVAFPSEYTVQKLKRDHLLLPIDHNKVPNIKNLDSDYMNMSFDRGNKYSLPYFFGTVGILYNKEKYPNESFDSWKSLYNPKFKNQILLVDGAREIIGMSLNKLGYNLNDRNSHHLKEAERDLTKLAPQVRGVVGDEITMMLQQNEGNIAVVWSGVAAPLVQEGDKYNYVIPKEGSNLWFDNMVIPKTAQNKEGAYKFMNFLLDAKNNKQNTEFVGYATPNKAARQLLPKEIKDDHRFYPTKKEQERLEVYKDLGPEVLSEYNENFLNFKMSLK

SEQ ID NO: 5009 - DNA, 816 bp, Staphylococcus aureus
gtgaatcatatgaaatggtatggaaagctgtatatcgggatacttttagcgattttatacatcccaatattctttttaatgttctattcattcaattcggctggtaatatgattcactttgaacattttacattagagcattatcaatcattatttcaaaatgatcatttaatgtcggtcatttttaatacgatagctgtagcacttttagcagcctcaatttctacagttattggtacatttggtgccattgctatttattatttaagaaataaaaagtttaaagtaactttactaacattgaataatgtcttgatggtatcatccgacgttgtcataggtgcatcattcttaattatgtttacaacgattggccattttactggtcttggtttaggattttggacagttctaatatctcatattgcattttgcatacctatagttgtgattatcgtcttaccacaactgtatgaaatgaataataatatgttaaatgctgcaagagatttaggagcgactgaaccacaattattaagcaacattattattcctaatattttaccttctattataggaggattctttatggctttaacttattcactagacgatttcacagtaagtttcttcgttactggtaatggctttagtgtgttatcagttgaagtttatgctatggcgagaaaaggaattagtatggaaattaatgcgatttcaacattattgtttgctgttattgtattaggaatactaggatattatttgattcaatacgtgataaataagaaaaaactaatcaagcgaggtgtaaaa

SEQ ID NO: 5010 - protein, 272 aa, Staphylococcus aureus
  MISC_FEATURE (1)..(272): spermidine/putrescine ABC
VNHMKWYGKLYIGILLAILYIPIFFLMFYSFNSAGNMIHFEHFTLEHYQSLFQNDHLMSVIFNTIAVALLAASISTVIGTFGAIAIYYLRNKKFKVTLLTLNNVLMVSSDVVIGASFLIMFTTIGHFTGLGLGFWTVLISHIAFCIPIVVIIVLPQLYEMNNNMLNAARDLGATEPQLLSNIIIPNILPSIIGGFFMALTYSLDDFTVSFFVTGNGFSVLSVEVYAMARKGISMEINAISTLLFAVIVLGILGYYLIQYVINKKKLIKRGVK

SEQ ID NO: 5011 - DNA, 795 bp, Staphylococcus aureus
atgcgtaatactaataaatttctcttaatcccgtatttactatggatggttatatttattattgtaccagttgtattactcatttatttttcatttttagatatcaatggacattttagtttcacgaattatcaacaaatttttactacaaaatatttgaaaatgtttgcatattcaattttatatgccgcttcaataacaattattaccttgactatcagttatccagctgcctattatattactcgttcgaaatttcaaaatatcttattaatgataatgattattccaacatggataaatttattgttaaagacatatgcttttataggtttattaagtcatgatggcgtgattaatcaatttttccacttatttaatttaccatcattcaatttgttatttacaactggtgcgtttttagtagtggcaagttacatttatataccatttatgattttacctatatttaatagcatgaaagcaattcctaataatttattgcaggcctcaagtgatttaggtgccagtcctttctatacttttagaaaagtaatcatgccgttaacaaaagaaggtgttatgactgggattcaagtaacctttattccatcactttcattatttatgattacaagattaattgcaggtaataaagtcataaatataggtacggcaatagaggaacaatttttaacaattcaaaattatggtatgggatcaactatagctatattcttaattgtatttatggcattcattttaatcattacaaaatcatctaatgggagaggg

SEQ ID NO: 5012 - protein, 265 aa, Staphylococcus aureus
  MISC_FEATURE (1)..(265): spermidine/putrescine ABC
MRNTNKFLLIPYLLWMVIFIIVPVVLLIYFSFLDINGHFSFTNYQQIFTTKYLKMFAYSILYAASITIITLTISYPAAYYITRSKFQNILLMIMIIPTWINLLLKTYAFIGLLSHDGVINQFFHLFNLPSFNLLFTTGAFLVVASYIYIPFMILPIFNSMKAIPNNLLQASSDLGASPFYTFRKVIMPLTKEGVMTGIQVTFIPSLSLFMITRLIAGNKVINIGTAIEEQFLTIQNYGMGSTIAIFLIVFMAFILIITKSSNGRG

SEQ ID NO: 5013 - DNA, 1092 bp, Staphylococcus aureus
ttggaaccgttattatcattaaaatcagttagtaaaagctatgatgatcttaatatcttagatgacatagatattgatattgaatcaggatacttttatacattattaggtccttcaggttgtggtaaaacaacaattttaaaattaattgcagggtttgaatatcctgacagtggtgaagtgatttatcaaaacaaaccaattggtaatttaccaccaaataaacgtaaagtgaatacagtctttcaagattatgcattatttccacacttaaacgtctatgataatatcgcttttggtttgaaattaaaaaaattatcaaaaaccgaaattgatcaaaaagtaactgaggcattaaaattagtaaaactttcaggttatgaaaaaagaaatattaatgaaatgagtggcggacaaaagcaacgtgttgcaattgcacgtgctatcgtaaatgaaccagaaatattattgttagatgaatctttatccgcattagatttgaaattgcgtactgaaatgcaatatgaattacgagaattgcaatctagattaggtattacatttatatttgtaacacatgatcaagaagaagcgttagcattaagtgactttctttttgtattaaaagatgggaaaattcaacaatttggcacaccaacagatatatatgacgaaccagtgaatcgatttgtagctgattttattggagaatctaatattgttgaagggcgcatggttagagattatgtcgtgaatatttatgggcaagatttcgaatgtgtcgatatgggtattcctgaaaataaaaaagtagaagtcgttattcgaccagaagatatatcattaatcaaagctgaagaaggattatttaaagcaactgttgattctatgttatttagaggggtccactatgaaatatgttgtatagacaataaaggttatgaatgggtaatacaaacgactaaaaaagctgaagtaggcagtgaagttggtctttattttgatcctgaagccattcatattatggttcctggagaaacagaagaagaatttgataaacgtattgaaagctatgaggaagtagacaatgcg

SEQ ID NO: 5014 - protein, 364 aa, Staphylococcus aureus
  MISC_FEATURE (1)..(364): spermidine/putrescine ABC
LEPLLSLKSVSKSYDDLNILDDIDIDIESGYFYTLLGPSGCGKTTILKLIAGFEYPDSGEVIYQNKPIGNLPPNKRKVNTVFQDYALFPHLNVYDNIAFGLKLKKLSKTEIDQKVTEALKLVKLSGYEKRNINEMSGGQKQRVAIARAIVNEPEILLLDESLSALDLKLRTEMQYELRELQSRLGITFIFVTHDQEEALALSDFLFVLKDGKIQQFGTPTDIYDEPVNRFVADFIGESNIVEGRMVRDYVVNIYGQDFECVDMGIPENKKVEVVIRPEDISLIKAEEGLFKATVDSMLFRGVHYEICCIDNKGYEWVIQTTKKAEVGSEVGLYFDPEAIHIMVPGETEEEFDKRIESYEEVDNA

SEQ ID NO: 5015 - DNA, 537 bp, Staphylococcus aureus
atgaacataggtaataaaattaaaaatcttagaagaattaaaaatttaacgcaagaagaacttgctgaacgtacagacttatcgaaaggctacatttcacaaatagaaagtgaacatgcctcaccaagtatggaaactttcttaaatattatagaggtgttaggaacgacgccaagtgaattttttaaagacagtgaaaatgaaaaagtattatacaagaaggaagaacaagttatttatgatgagtatgatgaaggttatatattaaattggttagtttcaaagtcaaatgaatatgatatggagccattaatattaactttaaagcctggagcatcatataaaaattttaatccatcagagtctgatacgtttatttattgtatgtcaggtcagataacacttaatttaggcaaagagatatatcaagcacaagaagaagacgttttgtattttaaagcacgagataatcatcgtttgtcaaacgaatcaaacaatgaaacacgaatacttattgtagcgacagcttcatattta

SEQ ID NO: 5016 - protein, 179 aa, Staphylococcus aureus
  MISC_FEATURE (1)..(179): conserved hypothetical
MNIGNKIKNLRRIKNLTQEELAERTDLSKGYISQIESEHASPSMETFLNIIEVLGTTPSEFFKDSENEKVLYKKEEQVIYDEYDEGYILNWLVSKSNEYDMEPLILTLKPGASYKNFNPSESDTFIYCMSGQITLNLGKEIYQAQEEDVLYFKARDNHRLSNESNNETRILIVATASYL

SEQ ID NO: 5017 - DNA, 288 bp, Staphylococcus aureus
atggagggttcaacaatggaatatgagtatccaattgatttagactggagtaatgaagagatgatttcagtgataaatttctttaatcatgtagagaagtattatgaatccggcgtgacggcaggcgactttatgggtgcatataaaagatttaaagaaattgtgcctgctaaagcagaggaaaaacaaatttttaatactttcgaaaaaagtagtggctataatagttacaaagcagttcaagatgtaaaaactcactctgaagaacaaagagtaacagctaaaaaa

SEQ ID NO: 5018 - protein, 96 aa, Staphylococcus aureus
  MISC_FEATURE (1)..(96): conserved hypothetical
MEGSTMEYEYPIDLDWSNEEMISVINFFNHVEKYYESGVTAGDFMGAYKRFKEIVPAKAEEKQIFNTFEKSSGYNSYKAVQDVKTHSEEQRVTAKK

SEQ ID NO: 5019 - DNA, 1404 bp, Staphylococcus aureus
atggtagttggagatttcccaattgaaacagatactatagtaatcggagcaggtcctggtggatacgttgcagcaattcgtgcagctcaattaggacaaaaagtaacaatcgttgagaaaggtaatcttggtggtgtttgcttaaacgtaggatgtattccttcaaaagcattactacatgcttctcaccgttttgttgaagcacaacattctgaaaacttaggtgttattgctgaaagtgtttctttaaacttccaaaaagttcaagaattcaaatcatcagttgttaataaattaactggtggtgttgaaagcttacttaaaggtaacaaagttaacatcgttaaaggtgaagcatatttcgtagataacaatagcttacgtgttatggacgaaaagagcgcacaaacatacaactttaaaaatgcaatcattgcaacaggttcaagaccaattgaaattcctaatttcaaattcggtaaacgtgttatcgactcaacaggtgctttaaacttacaagaagtaccaggtaaattagttgtagttggtggaggatacattggatcagaattaggtacagcatttgctaactttggttcagaagtaaccatccttgaaggtgctaaagatatcttaggtggcttcgaaaaacaaatgacacaacctgttaaaaaaggtatgaaagaaaaaggtgttgaaatcgttactgaagctatggctaaatcagctgaagaaacagataacggagttaaagttacttatgaagctaaaggcgaagagaaaacaatcgaagctgattatgtattagtaactgtaggtcgtcgtccaaacacagacgaattaggcctagaagaattaggtgttaaattcgctgaccgtggattattagaagttgataaacaaagccgtacgtctatcagcaatatctatgcaattggtgatatcgttccaggtttaccacttgctcacaaagctagctatgaagctaaagttgctgctgaagcaattgatggtcaagctgctgaagttgattacattggtatgccagcagtatgctttactgaaccagaattagctacagttggttattcagaagcgcaagctaaagaagaaggtttagcaattaaagcttctaaattcccatatgcagcaaatggtcgtgcattatcattagatgatactaacggatttgttaaacttattacacttaaagaagatgatactttaatcggtgctcaagtagttggtactggtgcatcagatattatctctgaattaggtttagcaattgaagctggtatgaatgctgaagatatcgcattaacaatccatgcacatccaacattaggtgagatgactatggaagcagcagaaaaagctatcggatacccaatccatacaatg

SEQ ID NO: 5020 - protein, 468 aa, Staphylococcus aureus
  MISC_FEATURE (1)..(468): dihydrolipoamide
MVVGDFPIETDTIVIGAGPGGYVAAIRAAQLGQKVTIVEKGNLGGVCLNVGCIPSKALLHASHRFVEAQHSENLGVIAESVSLNFQKVQEFKSSVVNKLTGGVESLLKGNKVNIVKGEAYFVDNNSLRVMDEKSAQTYNFKNAIIATGSRPIEIPNFKFGKRVIDSTGALNLQEVPGKLVVVGGGYIGSELGTAFANFGSEVTILEGAKDILGGFEKQMTQPVKKGMKEKGVEIVTEAMAKSAEETDNGVKVTYEAKGEEKTIEADYVLVTVGRRPNTDELGLEELGVKFADRGLLEVDKQSRTSISNIYAIGDIVPGLPLAHKASYEAKVAAEAIDGQAAEVDYIGMPAVCFTEPELATVGYSEAQAKEEGLAIKASKFPYAANGRALSLDDTNGFVKLITLKEDDTLIGAQVVGTGASDIISELGLAIEAGMNAEDIALTIHAHPTLGEMTMEAAEKAIGYPIHTM

SEQ ID NO: 5021 - DNA, 1290 bp, Staphylococcus aureus
gtggcatttgaatttagattacccgatatcggggaaggtatccacgaaggtgaaattgtaaaatggtttgttaaagctggagatactattgaagaagacgatgttttagctgaggtacaaaacgataaatcagtagtagaaatcccatcaccagcatctggtactgtagaagaagttatggtagaagaaggtacagtagctgtagttggtgacgttattgttaaaatcgatgcacctgatgcagaagatatgcaatttaaaggtcatgatgatgattcatcatctaaagaagaacctgcgaaagaggaagcgccagcagagcaagcacctgtagctactcaaactgaagaagtagatgaaaacagaactgttaaagcaatgccttcagtacgtaaatacgcacgtgaaaaaggtgttaacattaaagcagtttctggatctggtaaaaatggtcgtattacaaaagaagatgtagatgcatacttaaatggtggtgcaccaacagcttcaaatgaatcagctgcttcagctacaagtgaagaagttgctgaaactcctgcagcacctgcagcagtaacattagaaggcgacttcccagaaacaactgaaaaaatccctgctatgcgtagagcaattgcgaaagcaatggttaactctaagcatactgcacctcatgtaacattaatggatgaaattgatgttcaagcattatgggatcaccgtaagaaatttaaagaaatcgcagctgaacaaggtactaagttaacattcttaccttatgttgttaaagcacttgtttctgcattgaaaaaatacccagcacttaacacttcattcaatgaagaagctggtgaaatcgttcataaacattactggaatatcggtattgcagcagacactgatagaggattattagtacctgttgttaaacatgctgatcgtaagtctattttccaaatttcagatgaaattaatgaattagctgttaaagcacgtgatggtaaattaacagccgatgaaatgaaaggtgctacatgcacaatcagtaatatcggttcagctggtggacaatggttcactccagttatcaatcacccagaagtagcaatcttaggaattggccgtattgctcaaaaacctatcgttaaagatggagaaattgttgcagcaccagtattagcattatcattaagctttgaccacagacaaattgatggtgcaactggccaaaatgcaatgaatcacattaaacgtttattaaataatccagaattattattaatggagggg

SEQ ID NO: 5022 - protein, 430 aa, Staphylococcus aureus
  MISC_FEATURE (1)..(430): dihydrolipoamide
VAFEFRLPDIGEGIHEGEIVKWFVKAGDTIEEDDVLAEVQNDKSVVEIPSPASGTVEEVMVEEGTVAVVGDVIVKIDAPDAEDMQFKGHDDDSSSKEEPAKEEAPAEQAPVATQTEEVDENRTVKAMPSVRKYAREKGVNIKAVSGSGKNGRITKEDVDAYLNGGAPTASNESAASATSEEVAETPAAPAAVTLEGDFPETTEKIPAMRRAIAKAMVNSKHTAPHVTLMDEIDVQALWDHRKKFKEIAAEQGTKLTFLPYVVKALVSALKKYPALNTSFNEEAGEIVHKHYWNIGIAADTDRGLLVPVVKHADRKSIFQISDEINELAVKARDGKLTADEMKGATCTISNIGSAGGQWFTPVINHPEVAILGIGRIAQKPIVKDGEIVAAPVLALSLSFDHRQIDGATGQNAMNHIKRLLNNPELLLMEG

SEQ ID NO: 5023 - DNA, 381 bp, Staphylococcus aureus
  MISC_FEATURE (1)..(381): n = g, a, t, or c
ttgaaatttaggagggacaaagatatgacattagagatttcaaatgattacggtaaaattgatatttcaaacgaagtgattgcttcggttgtaggtggaaaggccgttgaatgttatggtattgtaggtatggcatctagacaacaagttagagatggtattgcggaaatactacgacatgaaaattatgctaaaggcatcaaagtcactgaaaataatggcgtagtggatatagatatgtacattatagtaagtgacggtgtgaaaatagctcaacatgccaattatgcacaatccacagtgaaatatactttgggaaaaatcaactttattgtatcagtaaattccaatcaatatatatggtacaaggnntgtnacgtg

SEQ ID NO: 5024 - protein, 127 aa, Staphylococcus aureus
  MISC_FEATURE (1)..(127): Xaa = any amino acid
  MISC_FEATURE (1)..(127): conserved hypothetical
LKFRRDKDMTLEISNDYGKIDISNEVIASVVGGKAVECYGIVGMASRQQVRDGIAEILRHENYAKGIKVTENNGVVDIDMYIIVSDGVKIAQHANYAQSTVKYTLGKINFIVSVNSNQYIWYKXCXV

SEQ ID NO: 5025 - DNA, 975 bp, Staphylococcus aureus
atggcacaaatgacaatggttcaagcgattaatgatgcgcttaaaactgaacttaaaaatgaccaagatgttttaatttttggtgaagacgttggtgttaacggcggtgttttccgtgttactgaaggactacaaaaagaatttggtgaagatagagtattcgatacacctttagctgaatcaggtattggtggtttagcgatgggtcttgcagttgaaggattccgtccggttatggaagtacaattcttaggtttcgtattcgaagtatttgatgcgattgctggacaaattgcacgtactcgtttccgttcaggcggtactaaaactgcacctgtaacaattcgtagcccatttggtggtggcgtacacacaccagaattacacgcagataacttagaaggtattttagctcaatctccaggtctaaaggttgttattccttcaggcccatacgatgcgaaaggtttattaatttcttctattagaagtaatgacccagtcgtatacttagagcatatgaaattgtatcgttcattccgtgaagaagtacctgaagaagaatatacaattgacattggtaaggctaatgtgaaaaaagaaggtaatgacatttcaatcatcacatacggtgcaatggttcaagaatcaatgaaagctgcagaagaacttgaaaaagatggttattctgttgaagtaattgacttacgtactgttcaaccaatcgatgttgacacaattgtagcttcagttgaaaaaactggtcgtgcagttgtagttcaagaagcacaacgtcaagctggtgttggtgcagcagttgtagctgaattaagtgaacgtgcaatcctttcattagaagcacctattggaagagttgcagcagcagatacaatttatccattcactcaagctgaaaatgtttggttaccaaacaaaaatgacatcatcgaaaaagcaaaagaaactttagaattt

SEQ ID NO: 5026 - protein, 325 aa, Staphylococcus aureus
  MISC_FEATURE (1)..(325): pyruvate dehydrogenase E1
MAQMTMVQAINDALKTELKNDQDVLIFGEDVGVNGGVFRVTEGLQKEFGEDRVFDTPLAESGIGGLAMGLAVEGFRPVMEVQFLGFVFEVFDAIAGQIARTRFRSGGTKTAPVTIRSPFGGGVHTPELHADNLEGILAQSPGLKVVIPSGPYDAKGLLISSIRSNDPVVYLEHMKLYRSFREEVPEEEYTIDIGKANVKKEGNDISIITYGAMVQESMKAAEELEKDGYSVEVIDLRTVQPIDVDTIVASVEKTGRAVVVQEAQRQAGVGAAVVAELSERAILSLEAPIGRVAAADTIYPFTQAENVWLPNKNDIIEKAKETLEF

SEQ ID NO: 5027 - DNA, 1110 bp, Staphylococcus aureus
atggctcctaagttacaagcccaattcgatgcagtaaaagttttaaatgatactcaatcgaaatttgaaatggttcaaattttggatgagaatggtaacgtcgtaaatgaagacttagtacctgatcttacggatgaacaattagtggaattaatggaaagaatggtatggactcgtatccttgatcaacgttctatctcattaaacagacaaggacgtttaggtttctatgcaccaactgctggtcaagaagcatcacaattagcgtcacaatacgctttagaaaaagaagattacattttaccgggatacagagatgttcctcaaattatttggcatggtttaccattaactgaagctttcttattctcaagaggtcacttcaaaggaaatcaattccctgaaggcgttaatgcattaagcccacaaattattatcggtgcacaatacattcaagctgctggtgttgcatttgcacttaaaaaacgtggtaaaaatgcagttgcaatcacttacactggtgacggtggttcttcacaaggtgatttctacgaaggtattaactttgcagcagcttataaagcacctgcaattttcgttattcaaaacaataactatgcaatttcaacaccaagaagcaagcaaactgctgctgaaacattagctcaaaaagcaattgctgtaggtattcctggtatccaagttgatggtatggatgcgttagctgtatatcaagcaactaaagaagcacgtgaccgcgcagttgcaggtgaaggtccaacattaattgaaactatgacatatcgttatggtcctcatacaatggctggtgacgatccaactcgttacagaacttcagacgaagatgctgaatgggagaaaaaagacccattagtacgtttccgtaaattccttgaaaacaaaggtttatggaatgaagacaaagaaaatgaagttattgaacgtgcaaaagctgatattaaagcagcaattaaagaggctgataacactgaaaaacaaactgttacttctctaatggaaattatgtatgaagatatgcctcaaaacttagcagaacaatatgaaatttacaaagagaaggagtcgaag

SEQ ID NO: 5028 - protein, 370 aa, Staphylococcus aureus
  MISC_FEATURE (1)..(370): pyrubate dehydrogenase E1
MAPKLQAQFDAVKVLNDTQSKFEMVQILDENGNVVNEDLVPDLTDEQLVELMERMVWTRILDQRSISLNRQGRLGFYAPTAGQEASQLASQYALEKEDYILPGYRDVPQIIWHGLPLTEAFLFSRGHFKGNQFPEGVNALSPQIIIGAQYIQAAGVAFALKKRGKNAVAITYTGDGGSSQGDFYEGINFAAAYKAPAIFVIQNNNYAISTPRSKQTAAETLAQKAIAVGIPGIQVDGMDALAVYQATKEARDRAVAGEGPTLIETMTYRYGPHTMAGDDPTRYRTSDEDAEWEKKDPLVRFRKFLENKGLWNEDKENEVIERAKADIKAAIKEADNTEKQTVTSLMEIMYEDMPQNLAEQYEIYKEKESK

SEQ ID NO: 5029 - DNA, 639 bp, Staphylococcus aureus
gtggaggtacaagtaatgaaatttggaaaaacaatcgcagtagtattagcatctagtgtcttgcttgcaggatgtactacggataaaaaagaaattaaggcatatttaaagcaagtggataaaattaaagatgatgaagaaccaattaaaactgttggtaagaaaattgctgaattagatgagaaaaagaaaaaattaactgaagatgtcaatagtaaagatacagcagttcgcggtaaagcagtaaaggatttaattaaaaatgccgatgatcgtctaaaggaatttgaaaaagaagaagacgcaattaagaagtctgaacaagactttaagaaagcaaaaagtcacgttgataacattgataatgatgttaaacgtaaagaagtaaaacaattagatgatgtattaaaagaaaaatataagttacacagtgattacgcgaaagcatataaaaaggctgtaaactcagagaaaacattatttaaatatttaaatcaaaatgacgcgacacaacaaggtgttaacgaaaaatcaaaagcaatagaacagaactataaaaagttaaaagaagtatcagataagtatacaaaagtactaaataaggttggtaaagaaaagcaagacgttgatcaatttaaa

SEQ ID NO: 5030 - protein, 213 aa, Staphylococcus aureus
  MISC_FEATURE (1)..(213): conserved hypothetical
VEVQVMKFGKTIAVVLASSVLLAGCTTDKKEIKAYLKQVDKIKDDEEPIKTVGKKIAELDEKKKKLTEDVNSKDTAVRGKAVKDLIKNADDRLKEFEKEEDAIKKSEQDFKKAKSHVDNIDNDVKRKEVKQLDDVLKEKYKLHSDYAKAYKKAVNSEKTLFKYLNQNDATQQGVNEKSKAIEQNYKKLKEVSDKYTKVLNKVGKEKQDVDQFK

SEQ ID NO: 5031 - DNA, 621 bp, Staphylococcus aureus
atgtatgagtatcttaacaacctttttactgtcattcaactaaaacaaattaaaataaggaaggtgcaatatatgttaacaatgaaagacatcattagagatggtcatccaactttgcgtcaaaaagcagctgagttagaattaccattaactaaagaagaaaaagaaacattaatcgccatgagagagtttttagtaaatagtcaagatgaggaaatcgcgaaacgatatggtttacgttcaggcgttggtttggctgcacctcaaattaatatttctaaacgtatgattgctgttttaataccagatgatggcagtggcaaatcttatgactatatgcttgtgaacccaaaaattgtaagtcatagcgttcaagaagcttatttaccaactggtgaaggttgccttagtgtcgatgataatgttgctggtctagttcaccgtcataatagaattacaattaaagccaaagacatcgaaggtaatgatatacaattacgactaaaaggatatccagcaattgttttccaacatgaaattgaccatttaaatggtgtaatgttctatgatcacattgacaaagatcacccattacaaccacatacagatgcagtagaagtt

SEQ ID NO: 5032 - protein, 207 aa, Staphylococcus aureus
  MISC_FEATURE (1)..(207): formylmethionine
MYEYLNNLFTVIQLKQIKIRKVQYMLTMKDIIRDGHPTLRQKAAELELPLTKEEKETLIAMREFLVNSQDEEIAKRYGLRSGVGLAAPQINISKRMIAVLIPDDGSGKSYDYMLVNPKIVSHSVQEAYLPTGEGCLSVDDNVAGLVHRHNRITIKAKDIEGNDIQLRLKGYPAIVFQHEIDHLNGVMFYDHIDKDHPLQPHTDAVEV

SEQ ID NO: 5033 - DNA, 120 bp, Staphylococcus aureus
atgaacgacatgatgaacctagttattaaccaaatcgttattaagttacattatagagatgattggaatgaatttatcgatatatactccaatacgattttactagggttaacaataaat

SEQ ID NO: 5034 - protein, 40 aa, Staphylococcus aureus
MNDMMNLVINQIVIKLHYRDDWNEFIDIYSNTILLGLTIN

SEQ ID NO: 5035 - DNA, 216 bp, Staphylococcus aureus
atggcagtatttaaagttttttatcaacataacagagacgaggtaattgtgcgtgaaaatacacaatcactttatgttgaagctcaaacagaagaacaagtacgtcgttacttgaaagatcgtaattttaatatcgaatttatcactaaattagagggcgcacatttagattacgaaaaagaaaactcagaacactttaatgtggagattgctaaa

SEQ ID NO: 5036 - protein, 72 aa, Staphylococcus aureus
  MISC_FEATURE (1)..(72): conserved hypothetical
MAVFKVFYQHNRDEVIVRENTQSLYVEAQTEEQVRRYLKDRNFNIEFITKLEGAHLDYEKENSEHFNVEIAK

SEQ ID NO: 5037 - DNA, 1695 bp, Staphylococcus aureus
atgaaacaattacatccaaatgaagtaggtgtatatgcacttggaggtctaggtgaaatcggtaaaaatacttatgcagttgagtataaagacgaaattgtcattatcgatgcaggtatcaaattccctgatgataacttattagggattgattatgttatacctgactacacatatctagttcaaaaccaagataaaattgttggcctatttataacacatggtcacgaagaccatataggcggtgtgcccttcctattaaaacaacttaatatacctatttatggtggtcctttagcattaggtttaatccgtaataaacttgaagaacatcatttattacgtactgctaaactaaatgaaatcaatgaggacagtgtgattaaatctaagcactttacgatttctttctacttaactacacatagtattcctgaaacttatggcgtcatcgtagatacacctgaaggaaaagtagttcataccggtgactttaaatttgattttacacctgtaggcaaaccagcaaacattgctaaaatggctcaattaggcgaagaaggcgttctatgtttactttcagactcaacaaattcacttgtgcctgattttactttaagcgaacgtgaagttggtcaaaacgtagataagatcttccgtaattgtaaaggtcgtattatatttgctaccttcgcttctaatatttaccgagttcaacaagcagttgaagctgctatcaaaaataaccgtaaaattgttacgttcggtcgttcgatggaaaacaatattaaaataggtatggaacttggttatattaaagcaccacctgaaacatttattgaacctaataaaattaataccgtaccgaagcatgagttattgatactatgtactggttcacaaggtgaaccaatggcagcattatctagaattgctaatggtactcataagcaaattaaaattatacctgaagataccgttgtatttagttcatcacctatcccaggtaatacaaaaagtattaacagaactattaattccttgtataaagctggtgcagatgttatccatagcaagatttctaacatccatacttcagggcatggttctcaaggtgatcaacaattaatgcttcgattaatcaagccgaaatatttcttacctattcatggtgaataccgtatgttaaaagcacatggtgagactggtgttgaatgcggcgttgaagaagataatgtcttcatctttgatattggagatgtcttagctttaacacacgattcagcacgtaaagctggtcgcattccatctggtaatgtacttgttgatggtagtggtatcggtgatatcggtaatgttgtaataagagaccgtaagctattatctgaagaaggtttagttatcgttgttgttagtattgattttaatacaaataaattactttctggtccagacattatttctcgaggatttgtatatatgagggaatcaggtcaattaatttatgatgcacaacgcaaaatcaaaactgatgttattagtaagttaaatcaaaataaagatattcaatggcatcagattaaatcttctatcattgaaacattacaaccttatttatttgaaaaaacagctagaaaaccaatgattttaccagtcattatgaaggtaaacgaacaaaaagaatcaaacaataaa

SEQ ID NO: 5038 - protein, 565 aa, Staphylococcus aureus
  MISC_FEATURE (1)..(565): conserved hypothetical
MKQLHPNEVGVYALGGLGEIGKNTYAVEYKDEIVIIDAGIKFPDDNLLGIDYVIPDYTYLVQNQDKIVGLFITHGHEDHIGGVPFLLKQLNIPIYGGPLALGLIRNKLEEHHLLRTAKLNEINEDSVIKSKHFTISFYLTTHSIPETYGVIVDTPEGKVVHTGDFKFDFTPVGKPANIAKMAQLGEEGVLCLLSDSTNSLVPDFTLSEREVGQNVDKIFRNCKGRIIFATFASNIYRVQQAVEAAIKNNRKIVTFGRSMENNIKIGMELGYIKAPPETFIEPNKINTVPKHELLILCTGSQGEPMAALSRIANGTHKQIKIIPEDTVVFSSSPIPGNTKSINRTINSLYKAGADVIHSKISNIHTSGHGSQGDQQLMLRLIKPKYFLPIHGEYRMLKAHGETGVECGVEEDNVFIFDIGDVLALTHDSARKAGRIPSGNVLVDGSGIGDIGNVVIRDRKLLSEEGLVIVVVSIDFNTNKLLSGPDIISRGFVYMRESGQLIYDAQRKIKTDVISKLNQNKDIQWHQIKSSIIETLQPYLFEKTARKPMILPVIMKVNEQKESNNK

SEQ ID NO: 5039 - DNA, 660 bp, Staphylococcus aureus
atgggtaaagaatatgtagtcatcggtctaggtcgttttggaggtagtatcgttcgtgagttgaatgcattagacatggatgtaatggccatcgaccatgatgaaaatagagtgaatgaatatagtgatatcgctactcatgcggttgttgcagacactacagatgaagcagttatgaaaagtttaggtatccgtaactttgatcatgtcattgtggcaattggtgaaaatattcaatcaagtacgttgacgactttaattttaaaagagttaggtgtaaaaaaagtaactgctaaagcacaaaatgattatcatgcaaagattttaaataaaattggagcagatacggttgtgcaccctgagcgtgatatgggtagacgtattgcgcataatgttgcgagtgcaagtgtacttgattatcttgagttggcagacgagcattctattgtagaattgaaagcaactgaaaagatggcggggcagtctatcattgatttagatataagagcacaatatggaattaacattattgcaattaaacgaggcaaagagttcatcatttcaccaaatccaaatattaatttagaaataggtgatattttaatcatgattggacatgataatgatttaaatcgctttgaaaaaaatattgcgacgaga

SEQ ID NO: 5040 - protein, 220 aa, Staphylococcus aureus
  MISC_FEATURE (1)..(220): conserved hypothetical
MGKEYVVIGLGRFGGSIVRELNALDMDVMAIDHDENRVNEYSDIATHAVVADTTDEAVMKSLGIRNFDHVIVAIGENIQSSTLTTLILKELGVKKVTAKAQNDYHAKILNKIGADTVVHPERDMGRRIAHNVASASVLDYLELADEHSIVELKATEKMAGQSIIDLDIRAQYGINIIAIKRGKEFIISPNPNINLEIGDILIMIGHDNDLNRFEKNIATR

SEQ ID NO: 5041 - DNA, 1017 bp, Staphylococcus aureus
atgatttatgcatttataggtataacagtgttatggttgtttttattttgctatatcattattgcttctatagattttggggcaggtttcttcgcattgcattcaaagttaactggtgatgaaaagaaaattaatcacttaatttcacgttatttaaacccagtttgggaagttacgaatgtattctttgttttcttcttcgtaggattcgtaggtttctttccagagtcaatcaaatatttaggcacggtattgttaataccaggttcaatagcactgattatgatatcgttgagaaacagtttttatgcatttgaaaattatggtcaagatacaaaattagcatggatgatcatgtatggggtaagtggattattaattccagcttcattatctactgctttaactattacagaaggtggctatattaatgttcgaaacaatgttatcgatctagattgggtgcagttattattaagcccatttgcttggtctgtagtattcttggcaattatttcagttttatatatttcatcaggatttttgacatattatgctaaaaaagcaaatgacgaaccagcatataatttaacaagacaatggcacatatttttagggccgccgatgattatcatttgtttattcgtatttctatcattacgcattcaaaattctgaacatttttattcagctgtttttgactattggtggatgtttggtataagtttcttattctttgcattagcttcattgttaacattctttaagaaaaaacatggtttggcttttgtatttgttattttacaaatgatgttcgcgttctttggctatggaattagtaaattgccataccttttatatccgtttgtaaaaattacagatgcatatgttaatccagaaatgggctggacattagtgattgtctttattttaggtttacttttattacttccatcgttaatattattattaagattatttgttttcgacaaagaatatgttgaaggaaagaaatca

SEQ ID NO: 5042 - protein, 339 aa, Staphylococcus aureus
  MISC_FEATURE (1)..(339): cytochrome D ubiquinol
MIYAFIGITVLWLFLFCYIIIASIDFGAGFFALHSKLTGDEKKINHLISRYLNPVWEVTNVFFVFFFVGFVGFFPESIKYLGTVLLIPGSIALIMISLRNSFYAFENYGQDTKLAWMIMYGVSGLLIPASLSTALTITEGGYINVRNNVIDLDWVQLLLSPFAWSVVFLAIISVLYISSGFLTYYAKKANDEPAYNLTRQWHIFLGPPMIIICLFVFLSLRIQNSEHFYSAVFDYWWMFGISFLFFALASLLTFFKKKHGLAFVFVILQMMFAFFGYGISKLPYLLYPFVKITDAYVNPEMGWTLVIVFILGLLLLLPSLILLLRLFVFDKEYVEGKKS

SEQ ID NO: 5043 - DNA, 1059 bp, Staphylococcus aureus
atgagtaacgcaaataatgctgataataaacagtttttcagtaagattttaaattctattggtgctggtgttgttattgcacttgttccgaatgctttattaggtgaagtattaaaaatatttaaaagtggtaatgaaattttagaattaacgtatcagttagtgatactaattcaatcatttatggcatttattattggggttttagctgctcatcaatttaaatttaatggtgcaggtgctgctatagtaggtacatcagctatgattggttcaggtgctgttgtatatagcaataatagttttatgttaaaaggtataggtgacattataaatacgagtttggttgttattattgcatgtcttatatatatggtattacaaaacaaacttggatcttttgaattaattatattaccagttttagtacctatcgttagtgggggtatcggtctaatcacattaccttacattcgaaaaattactcaagcaattggaaatgtaattcattcttttacagacttaaatccgttgttaatgtctatacttattagtgtggcattttcattattaatggtaacaccaatatcgttagtagcgattgcaactgcgattagtttaaacggactaggaagtggagcagcaaacctaggtatagtggctgcctgtgttactttcttatttggctcattgcgtgtcaattctattggtgtaaatgcagttttactcataggagctgcaaaaatgatgatcccagtttacttgaaaaatttaattatttcgataccattgactataaatggaataattactggaatcattgcttacgttcttcaggttaaaggaacaccattgtctgctggatttggatatacaggattagttggcccaataaatgcatttaaccgaatgtcaggtgatccaacaatgaatattattttattagcacttggttattttgtcataccatttgtatcggcatttattgttcatgaattgtgtaaaaaattcattcctatatattctaatgatatttataaatttgaagttccaaaacaa

SEQ ID NO: 5044 - protein, 353 aa, Staphylococcus aureus
  MISC_FEATURE (1)..(353): hypothetical protein
MSNANNADNKQFFSKILNSIGAGVVIALVPNALLGEVLKIFKSGNEILELTYQLVILIQSFMAFIIGVLAAHQFKFNGAGAAIVGTSAMIGSGAVVYSNNSFMLKGIGDIINTSLVVIIACLIYMVLQNKLGSFELIILPVLVPIVSGGIGLITLPYIRKITQAIGNVIHSFTDLNPLLMSILISVAFSLLMVTPISLVAIATAISLNGLGSGAANLGIVAACVTFLFGSLRVNSIGVNAVLLIGAAKMMIPVYLKNLIISIPLTINGIITGIIAYVLQVKGTPLSAGFGYTGLVGPINAFNRMSGDPTMNIILLALGYFVIPFVSAFIVHELCKKFIPIYSNDIYKFEVPKQ

SEQ ID NO: 5045 - DNA, 1236 bp, Staphylococcus aureus
gtgaccaaacccaaactaaaggagacaagtgcgcctatgtgtaatgataccttagaattactaagaataaaagatgaaaatataaaatatataaaccaagaaattgacgtcattatcaaaggaaaaaaagcaacagtggttaatgctgtactaacgtataagccttcggcctgttattgttgtggagttaaaaatgaaggacaaattcataaacatggtaagcgtgtttctcgtattactttacttaaaactcaagggtataacacatacctcaacttagctaaacaacgttttaaatgcttagaatgcaatggcacttttactgctaaaacgtcaattgttgatgagtcgtgttttatctcaagatgtgttactcaaaaagttatagaagaagctactaaagttaaaacagagattgatactgcagaagataactgtatctctccatctactgtaagtcgtattagaactaaagcggctaattcattacgaattaaaccctttaattgtttgccagaacacatcgctatggatgaatttaaaagcgttaaaaatgtaactggatcaatgagtttcatttttatagataatgacactcatgatgttatagatattttagaaaatagaactacaagattcttgcgtgcctatttcgagcgattcgatttaaaaaatcgacaccaagttaagccggttactattgacatgtatgaaccctatgtccgattatttcgcgacctatttcctaatgcagctattatttttgacagattccatatcgttcaacatttaaatagagaacttaataagtatcgtgtacaagttatgaatgaataccgtaataaaaaaggacctgattatacaatttttaagaataactggaaagtcctattgatggatactagtaaaaccatatttagtaaatacagatggaataaatcttttaaggcttataaacgctcatctgacattgtagaattcatgctttcaaaagacgatatactacgacactcctacgaacttgtccaaggattacgaaaagacctaaggttatgtaattggcctaaatttattaatcgtttaaattcagttagtaaaaagtctgtgagtaagggtgtatggaaagtggttaaatattatagaaaacatcaaaggatgttaagaaatacaatttattacccagcatttaataatggtgctatagaaggaattaataataagataaaattaatcaag

SEQ ID NO: 5046 - protein, 412 aa, Staphylococcus aureus
  MISC_FEATURE (1)..(412): transposase [Staphylococcus
VTKPKLKETSAPMCNDTLELLRIKDENIKYINQEIDVIIKGKKATVVNAVLTYKPSACYCCGVKNEGQIHKHGKRVSRITLLKTQGYNTYLNLAKQRFKCLECNGTFTAKTSIVDESCFISRCVTQKVIEEATKVKTEIDTAEDNCISPSTVSRIRTKAANSLRIKPFNCLPEHIAMDEFKSVKNVTGSMSFIFIDNDTHDVIDILENRTTRFLRAYFERFDLKNRHQVKPVTIDMYEPYVRLFRDLFPNAAIIFDRFHIVQHLNRELNKYRVQVMNEYRNKKGPDYTIFKNNWKVLLMDTSKTIFSKYRWNKSFKAYKRSSDIVEFMLSKDDILRHSYELVQGLRKDLRLCNWPKFINRLNSVSKKSVSKGVWKVVKYYRKHQRMLRNTIYYPAFNNGAIEGINNKIKLIK

SEQ ID NO: 5047 - DNA, 1359 bp, Staphylococcus aureus
atggatacagttgaaatcagtcggtttttgacagctatgactttagcagttcatatcatttttgcaacgattggtgttggtatgcctttaatgttcgcaattgcagaatttttaggtattcgcaaaaatgatcttcaatatatagctatggccaaaagatgggctaaagcttatacaattactgtagcagtgggagttgttacaggtacaattataggacttcaattatcattgatttggcctacatttatggaaatgggtggacacgttattgcacttccattatttatggaaacatttgcgttcttctttgaagctattttcttaagtatatatttatatacttgggatcgttttaaaaataaatggacacatttcttaattagtataccagtaattattggtggctctttctcagcattcttcattacttcagtgaattcatttatgaatacgcctgcaggttttgagttgaagaatggaaagatggtcaatgttcaacctatagaagcgatgtttaacccatcgtttatagttcgatcatttcacgtaattactacagccggtatgacgatggcatttgttattgcatcaatagcagcttttaaattattgcgtaatcgtcaacctaaagatactgtctaccataagaaagctttgaaaatgtctatgatagttggattcttttcaacattactttctatgttggcaggggatttatctgcaaaatttttgcataaattccaacctgaaaaattagcagcttatgaatggcatttcgatacatcttcccatgccaaattattattatttggtgtgttagatgaaaagactcagcaagttaaaggtgcgattgaattacctggactattgagtttcttagcagataatagtgtcaaaactaaagtacaagggttaaatgattttccaaaaagtttacatccgcctatgatcgtccattatttctttgatttaatggtaacgatgggaattttatgttttgtcatttcaggtgtttatgtcttaactttaatgtttaaaaagcttagaaagttttctactcataaatggatgctttatggaatattattaacaggcccagcttcaatgctagctatagaatttggatggttcttaacagagatgggtagacagccttggattgttcgtggttatatgcgcgtggcagaagcagcaacacaagcaggcggaataaccttcgttacaattttatttggcatattgtacatcattttaatgtatacatgtgcatacgtattaattcgtatgtttaaaaataaaccggcgtatgaagatgtaaatcgtttagccaagaagcaaggaggagaaatagaaaaa

SEQ ID NO: 5048 - protein, 453 aa, Staphylococcus aureus
  MISC_FEATURE (1)..(453): cytochrome D ubiquinol
MDTVEISRFLTAMTLAVHIIFATIGVGMPLMFAIAEFLGIRKNDLQYIAMAKRWAKAYTITVAVGVVTGTIIGLQLSLIWPTFMEMGGHVIALPLFMETFAFFFEAIFLSIYLYTWDRFKNKWTHFLISIPVIIGGSFSAFFITSVNSFMNTPAGFELKNGKMVNVQPIEAMFNPSFIVRSFHVITTAGMTMAFVIASIAAFKLLRNRQPKDTVYHKKALKMSMIVGFFSTLLSMLAGDLSAKFLHKFQPEKLAAYEWHFDTSSHAKLLLFGVLDEKTQQVKGAIELPGLLSFLADNSVKTKVQGLNDFPKSLHPPMIVHYFFDLMVTMGILCFVISGVYVLTLMFKKLRKFSTHKWMLYGILLTGPASMLAIEFGWFLTEMGRQPWIVRGYMRVAEAATQAGGITFVTILFGILYIILMYTCAYVLIRMFKNKPAYEDVNRLAKKQGGEIEK

SEQ ID NO: 5049 - DNA, 231 bp, Staphylococcus aureus
atgtcagaaataatcgtttatacgcagaatgattgtccaccttgtacatttgtaaaaaattatctaaatgagcatcacattgattttgaagagagaaatatcaacaatcaacaatatcgaaacgaaatgatagattttgatgctttttcaactccgtttattttgttgaatggcaatccaatgtaccatgttgatcttgatgaaatcaacaaagtattaaatatccaagat

SEQ ID NO: 5050 - protein, 77 aa, Staphylococcus aureus
  MISC_FEATURE (1)..(77): conserved hypothetical
MSEIIVYTQNDCPPCTFVKNYLNEHHIDFEERNINNQQYRNEMIDFDAFSTPFILLNGNPMYHVDLDEINKVLNIQD

SEQ ID NO: 5051 - DNA, 1716 bp, Staphylococcus aureus
atgtctaaattaattaaaggtattgccgcatctgatggtgtcgcaattgctaaagcttatttattagttgagccagacttaacattcgacaaaaatgaaaaagtcactgatgttgaaggagaagttgcaaagttcaatagcgctatcgaagcttctaaagttgagttaactaaaattagaaataatgcagaggttcaactaggtgctgataaagctgctatctttgatgcacatttattagttttagatgaccctgaattaattcaaccaatccaagataagattaaaaatgaaaacgctaatgctgctacagcattaacggatgtaacaacacaatttgttacaatttttgaatctatggataacgaatacatgaaagaacgtgcggctgatattcgcgacgtttctaaacgtgtgttatcacatattttaggtgtagaattaccgaatccgagtatgattgatgaaagcgttgttattgtagggaatgacttaacgccatctgatactgctcaattaaataaagaattcgtacaaggttttgctacaaacattggcggaagaacaagtcactctgcaattatgagtcgttctttagaaattccagcaattgttggtacaaaatcaattactcaagaagttaaacaaggcgacatgattatcgtagatggattaaatggtgatgtaatcgttaatccaactgaagatgagttaatcgcttatcaagataaacgtgagcgttattttgctgacaagaaagaattacaaaaactacgtgatgctgatactgttacagttgatggtgttcacgcagagcttgctgcaaatattggtacacctaatgatttgccaggtgttattgaaaatggtgcacaaggtatcggcttatatagaactgagtttttatatatgggtcgtgaccaaatgcctacagaagaagaacaatttgaagcttataaagaagtattagaagcaatgggcggtaaacgtgttgttgtacgtactttagatataggtggagataaagaattatcatacttaaacttgcctgaagaaatgaatccattcttaggttaccgtgcgattcgtttatgccttgcgcaacaagatattttcagaccacagctacgtgcattattacgtgcatcagtttatggtaagttaaatatcatgttcccaatggttgcaacaattaacgaatttagagaagctaaagctatattattagaagaaaaagaaaaccttaaaaatgaaggtcatgacatttcggatgatatagaattaggaatcatggtagagatacctgcaacagcagcattagctgatgtctttgctaaagaagtagatttcttcagtatcggtacaaatgatttaattcaatacacattagctgctgaccgtatgtcagagcgtgtatcatatctataccaaccatataacccttcaatcttacgtttagttaaacaagttattgaagcgtcacataaagaaggtaaatggacaggtatgtgtggtgaaatggctggagatgaaacagctattccattattgcttggtttaggtttagatgagttctctatgagtgcaacgtctattctgaaagcaagaagacaaattaatggtttaagtaaaaatgaaatgactgaacttgctaaccgtgcagtcgactgtgcaacgcaagaagaagttattgaattagttaacaactacgtaaaa

SEQ ID NO: 5052 - protein, 572 aa, Staphylococcus aureus
  MISC_FEATURE (1)..(572): phosphoenolpyruvate-protein
MSKLIKGIAASDGVAIAKAYLLVEPDLTFDKNEKVTDVEGEVAKFNSAIEASKVELTKIRNNAEVQLGADKAAIFDAHLLVLDDPELIQPIQDKIKNENANAATALTDVTTQFVTIFESMDNEYMKERAADIRDVSKRVLSHILGVELPNPSMIDESVVIVGNDLTPSDTAQLNKEFVQGFATNIGGRTSHSAIMSRSLEIPAIVGTKSITQEVKQGDMIIVDGLNGDVIVNPTEDELIAYQDKRERYFADKKELQKLRDADTVTVDGVHAELAANIGTPNDLPGVIENGAQGIGLYRTEFLYMGRDQMPTEEEQFEAYKEVLEAMGGKRVVVRTLDIGGDKELSYLNLPEEMNPFLGYRAIRLCLAQQDIFRPQLRALLRASVYGKLNIMFPMVATINEFREAKAILLEEKENLKNEGHDISDDIELGIMVEIPATAALADVFAKEVDFFSIGTNDLIQYTLAADRMSERVSYLYQPYNPSILRLVKQVIEASHKEGKWTGMCGEMAGDETAIPLLLGLGLDEFSMSATSILKARRQINGLSKNEMTELANRAVDCATQEEVIELVNNYVK

SEQ ID NO: 5053 - DNA, 300 bp, Staphylococcus aureus
ttgaagattctaactatacgaaggagaaatgtaattatggaacaaaattcatatgtaatcatcgacgagactggtattcacgctagaccagcaacaatgttagtacaaacagcttcaaaattcgattctgatattcaattagaatataacggtaagaaagtaaacttaaaatcaatcatgggtgttatgagccttggtgttggtaaagatgctgaaattacaatttatgctgacggtagtgatgaatctgacgccattcaagcaatcagtgacgtcttatcaaaagaaggattgactaaa

SEQ ID NO: 5054 - protein, 100 aa, Staphylococcus aureus
  MISC_FEATURE (1)..(100): phophocarrier protein Hpr
LKILTIRRRNVIMEQNSYVIIDETGIHARPATMLVQTASKFDSDIQLEYNGKKVNLKSIMGVMSLGVGKDAEITIYADGSDESDAIQAISDVLSKEGLTK

SEQ ID NO: 5055 - DNA, 540 bp, Staphylococcus aureus
atgggattcaaaaacaatttaacatcaaatttaacaaataaaatcggtaattcagtctttaaaatagaaaatgttgacggaaaaggtgcaatgccaacgacgattcaagaattgagagaaagacgacaacgtgctgaagcaattgtaaagagaaagtctttaatgtcatcaacaatgagcgttgttccaattccgggtttagattttggtgttgatttaaaattaatgaaagatattatcgaagatgttaataaaatttatggtttagatcataagcaagttaatagccttggggatgatgtgaaagaaagaattatgtctgcagcagcaattcaaggtagtcaatttattggtaaaagaatttcaaatgcatttttaaaaattgtaattagagatgtagctaaacgtactgctgcaaaacaaacaaaatggtttcctgttgtaggacaagctgtgtctgcatctattagttactattttatgaataaaattggaaaagatcacattcaaaaatgcgaaaatgttattaaaaatgtcatg

SEQ ID NO: 5056 - protein, 180 aa, Staphylococcus aureus
  MISC_FEATURE (1)..(180): hypothetical protein
MGFKNNLTSNLTNKIGNSVFKIENVDGKGAMPTTIQELRERRQRAEAIVKRKSLMSSTMSVVPIPGLDFGVDLKLMKDIIEDVNKIYGLDHKQVNSLGDDVKERIMSAAAIQGSQFIGKRISNAFLKIVIRDVAKRTAAKQTKWFPVVGQAVSASISYYFMNKIGKDHIQKCENVIKNVM

SEQ ID NO: 5057 - DNA, 1170 bp, Staphylococcus aureus
atgaaaatagcaactctgaacaaaggcaaagaaacaaaatattttaatggatatcctttaattgaagaagaggatatctattcacaagatcatttaaaagaaggagatatttttcaaattgtgactgataaatcacaatatgtcgcaacggcttatgttggtcgccaacataaaggattaggttgggttctaacatacgataaagctcaacaaatcaacacagctttctttgtaaaattgtttaatactgcattagcagaacgtgattattattttaatatagatggaacaaatgcttttagattatttaatgctgaaggtgatggtgttgggggattaacaatcgacaattacgatggtcatttgttgattcaatggtactcaaaaggtatttataaatttaaatatgccattcttgaagcggttagaaaagtatttgattataaatctatttacgaaaaagtaagatttaaagacagcgaatatagtggtggttttgttgaaggagatgcacctgagtttccaattgttatcgaagaaaacttcacattttataatgtagaccttgaagatggtttgatgacaggtatctttttagatcaaaaagaagtgcgcaagaaattaagggatcaatatgccaaagaacgccatgttttaaacttatttagttatacaggtgctttttctgcaatagcagcaagtgaggcatcttcaacaacaagtgtagatttggctaatcgttctcgtagtttaactgaagaaaattttggattaaatgctattgatcctaaatcccaatatatttatgtcatggacacttttgatttctataaatatgctgcacgacatggacatagttatgacacgatcgtgattgatccacctagctttgcgcgtaacaaaaaacgtacattttcagtgcaaaaagattatgacaaattaattaatggcgccttaaatatcttatcatctgaaggaacattattgttatgtacaaacgcaagtgtatatccattaaagcaatttaaaaatactattaaaaagacgcttgaagagagtggcgttgattatgaattaactgaagttatgggattaccaaaagattttaaaacgcatccacattataagccatctaaatatttaaaagctgtttttgtaaatattagacat

SEQ ID NO: 5058 - protein, 390 aa, Staphylococcus aureus
  MISC_FEATURE (1)..(390): conserved hypothetical
MKIATLNKGKETKYFNGYPLIEEEDIYSQDHLKEGDIFQIVTDKSQYVATAYVGRQHKGLGWVLTYDKAQQINTAFFVKLFNTALAERDYYFNIDGTNAFRLFNAEGDGVGGLTIDNYDGHLLIQWYSKGIYKFKYAILEAVRKVFDYKSIYEKVRFKDSEYSGGFVEGDAPEFPIVIEENFTFYNVDLEDGLMTGIFLDQKEVRKKLRDQYAKERHVLNLFSYTGAFSAIAASEASSTTSVDLANRSRSLTEENFGLNAIDPKSQYIYVMDTFDFYKYAARHGHSYDTIVIDPPSFARNKKRTFSVQKDYDKLINGALNILSSEGTLLLCTNASVYPLKQFKNTIKKTLEESGVDYELTEVMGLPKDFKTHPHYKPSKYLKAVFVNIRH

SEQ ID NO: 5059 - DNA, 1302 bp, Staphylococcus aureus
gtgaacataatgtcttttcttaggaaacacgccgaaattatttttagctatttaatcggtatcgtttcactcttcactggtctcattattttaattaacttgccattaattaaacaattaaatggtggtaaaaaagttgatacacatgttcataatgtgtgggaatttctgaatgcatttttcagtgaaattattaaagtaatgagtcgatttataggtaatttccctatagttagtgcaattgtgataattatattcggtattttagttatgttgattggtcatacattacttagaactattaagtatgactatgatatttctatctttttcttagttatcggtatcatgtactttattattactcttatattaatgactcaagtttatggattctttgcagtgattttcattattccatttacaattcatataggatatatcgtctataaagatgaattgaatcaggaaaatgtaaaaaatcatttcatgtggataattgtgagttatggtataagttacttaattacacaaattgcattgtatggcagaattgatgctaatgaaatagagtcaattgatatcttaagtgtcaatgctttctttataattatgtggttacttggtcaaatggctatttggaatttcttgttcttgcgccgagctttacctttaacaaagcaagaattaggtgaagaggagccagaattatcaagaacaagtaaagggaatgtcacgaatcaaactaaaattcacttgaaacaactccaagataagactacagaatatgcacgtaagacaagaagaagtgtcgatttagataaaattagagctaaaagagataaattcaaaaagaaagttaatgatattatcgatattcaagaagacgatattcctgattggatgagaaaaccgaaatgggttaaaccaatgtatgtcgaactattttgtggtgtcgtcatctttttattcacatttttagaatttaataatcgtaatgcattatttgtatctggtgattggaaattatcacagacacaatatgttattgaatgggttacattattaattctgttattcattattatcgcatatatcgctacaacgttaactttccacttgaaaggtaagttttattatttacaattatttatggggagcattttattctttaaattgttaacggaatttataaatataatgattcatggactattactttcagtgttcattacgccaacattactattaatgttattggcaatcatcatttcttattcgttacaattacgagagcgacca

SEQ ID NO: 5060 - protein, 434 aa, Staphylococcus aureus
  MISC_FEATURE (1)..(434): hypothetical protein
VNIMSFLRKHAEIIFSYLIGIVSLFTGLIILINLPLIKQLNGGKKVDTHVHNVWEFLNAFFSEIIKVMSRFIGNFPIVSAIVIIIFGILVMLIGHTLLRTIKYDYDISIFFLVIGIMYFIITLILMTQVYGFFAVIFIIPFTIHIGYIVYKDELNQENVKNHFMWIIVSYGISYLITQIALYGRIDANEIESIDILSVNAFFIIMWLLGQMAIWNFLFLRRALPLTKQELGEEEPELSRTSKGNVTNQTKIHLKQLQDKTTEYARKTRRSVDLDKIRAKRDKFKKKVNDIIDIQEDDIPDWMRKPKWVKPMYVELFCGVVIFLFTFLEFNNRNALFVSGDWKLSQTQYVIEWVTLLILLFIIIAYIATTLTFHLKGKFYYLQLFMGSILFFKLLTEFINIMIHGLLLSVFITPTLLLMLLAIIISYSLQLRERP

SEQ ID NO: 5061 - DNA, 132 bp, Staphylococcus aureus
atgtctaatgaaaatcaaaataaaaaagcagcagaaaaagctaaagaagttgaagaaaaattaaaagataaaaaagaagaaaaaacagaagatattaatcaaacaaaacaagatatccaagatacactaaat

SEQ ID NO: 5062 - protein, 44 aa, Staphylococcus aureus
  MISC_FEATURE (1)..(44): hypothetical protein
MSNENQNKKAAEKAKEVEEKLKDKKEEKTEDINQTKQDIQDTLN

SEQ ID NO: 5063 - DNA, 573 bp, Staphylococcus aureus
atgtcaaaaggtttaaagctatctgaaatactagtaaccgtacttatttcagtagtattcgcagttatttacaatttatggtggtttgtttacaatggtgtgcaagctacaggccttcacctcgaacaattaacaaacggggtttggttcatggcagcgattgtctgctatctaattattccaaaaccaggtattgctttactggctgaatttgctgcaggtgccggcgaaactatcattatgggtcgtttcgatattccgacaatcgtttacgcttttatacaaggtttagcgtgtgaacttgtctttgcaatttttaaatatcaatcacgttcagttatggtagctatgttagcaggtttttgtacagcaatcgcggctttcccgatagattatttctatggttatttaaatgaagttgcaggttggaacttaacattattcatcgtatttagattaattagtggtgcagtagtcgccggcgtcctatcttaccttttagtaaaagctttagataagacaggcgtaacaaaattatttagaccagctgctaaagaagattacgacaactta

SEQ ID NO: 5064 - protein, 191 aa, Staphylococcus aureus
  MISC_FEATURE (1)..(191): conserved hypothetical
MSKGLKLSEILVTVLISVVFAVIYNLWWFVYNGVQATGLHLEQLTNGVWFMAAIVCYLIIPKPGIALLAEFAAGAGETIIMGRFDIPTIVYAFIQGLACELVFAIFKYQSRSVMVAMLAGFCTAIAAFPIDYFYGYLNEVAGWNLTLFIVFRLISGAVVAGVLSYLLVKALDKTGVTKLFRPAAKEDYDNL

SEQ ID NO: 5065 - DNA, 1398 bp, Staphylococcus aureus
gtgttaaaagtaagtgatttacgattaaaatatccaagtggtcaacgtaaaattttcgatcatttaaatatcactattcaagacaaagaaaaagtacttttactcggtccttctggttgcggtaaaagtacacttctgaatgtattaagtggtattgttcctaatttaattgaattacctatgaaatatgatgaactaatcgttgacccattaagtggcgttattttccaagaccctgatagccagttttgtatgccaaaagtatacgaagaacttgcattcgttttagaaaatagacaattaccacgtgaagacatggatgcgttaattatcaatgctttaaatatggtcaatttaaatgttacccctgaaacgtatatcaaagatttaagtggcgggatgaaacagaaattggcaattgttgaaaccattcttcaacaatcaaaaacattgtttttagatgaaccgacagcaatgttagatgttcaagcaacagaagatttatggactaaactaattgaactttgggaagatcaaacggttgtaatcgttgaacataaagttaaacacatctggaatcatgtcgaccgcgtcattttgatggattataacggaaatatcattgccgatgaatgtcctgaaatcatattacagaagtatgttcatttactcagtgaatatggtgtgtggcatccacgtgcatgggaattcgcaccaagtcgtgttgactttccaacaacaaactcacacttattacaatttaaaaatggacgtattattcgcggtaaatcaacattgctctcattctcagatttagaaattggtctaggtgagtggattacaattacaggggcaaatggtagtggtaaaacaaccttgcttgaatcaattatgcaattgattaaatatcaaggtgatgtttattttgaaaatcagcgtttaacaaaaattaaacatgcagcaaaacacatgtacctagtttatcaaaacccagaattacaatttataacaaattcggtttatgatgaaattaacattcattttaatcacctttctaaagatcaaagtgatgatgaaacgatacaacttttaaaacttttagatttacaaaatgtaaaagatcaacatccttatgagttgtctattggtcaaaaacgacgccttagcgtagctaccgcactaagttctaaagctgatattatctttttagatgaaccgacatttggacttgatagccataatacattccagttgatcaaacttttccaaaagcgaattaatttgggacaaagtattgtcatggttacacatgacgatgaaataattgaacgttatccatcaagaagacttaaaatttcagatggtgcgttactagattgtgatggtgatacgaatgta

SEQ ID NO: 5066 - protein, 466 aa, Staphylococcus aureus
  MISC_FEATURE (1)..(466): hypothetical protein
VLKVSDLRLKYPSGQRKIFDHLNITIQDKEKVLLLGPSGCGKSTLLNVLSGIVPNLIELPMKYDELIVDPLSGVIFQDPDSQFCMPKVYEELAFVLENRQLPREDMDALIINALNMVNLNVTPETYIKDLSGGMKQKLAIVETILQQSKTLFLDEPTAMLDVQATEDLWTKLIELWEDQTVVIVEHKVKHIWNHVDRVILMDYNGNIIADECPEIILQKYVHLLSEYGVWHPRAWEFAPSRVDFPTTNSHLLQFKNGRIIRGKSTLLSFSDLEIGLGEWITITGANGSGKTTLLESIMQLIKYQGDVYFENQRLTKIKHAAKHMYLVYQNPELQFITNSVYDEINIHFNHLSKDQSDDETIQLLKLLDLQNVKDQHPYELSIGQKRRLSVATALSSKADIIFLDEPTFGLDSHNTFQLIKLFQKRINLGQSIVMVTHDDEIIERYPSRRLKISDGALLDCDGDTNV

SEQ ID NO: 5067 - DNA, 819 bp, Staphylococcus aureus
gtgatggtgatacgaatgtatgagcaatggaaagttcggcaatcatttgttgatgatgtcaacattataacgaaactatttcttggaattatactatttttctttattatatttgtgcataatttcgattttatgctttatatcactatcttaatgttagttttcttattgatgtttaatggtactcagtttaaaattacagcaatttttataactataagtattggctttgcattactctcttccctgttcatgattttatacgggaatggtagccatacaattttgaaattcggatttatccatattacaacagaaagtttagttcgtggtttacatgtatcattaagaaccattgctatttcatttttcggtatcttaatcgcacttacatctcaggttgtcatgatattttatagtttaatgcaacatttaaaggttaaatcaaaagttgcttatgcattcatggctgccattcgtatgatacctttaatgattagttctttaatacagcttcgcagatctttaaaaatgcgctatcagatgatagacgcggcaaattatagagggttaaagcgatttaagcatttaattatacctctattaagccaaaatattagaaaggcacatcaattatcagttgcgatggagtcgaaaggatttagagatggtcctcgtacttactattacaacgtacctttctcatataaagatataatctttattatagttttaattgccattattactatggcatattattgttcaatcaccttacccatcacgggcatagatgatgttcgtcttggtcgtgtaggt

SEQ ID NO: 5068 - protein, 273 aa, Staphylococcus aureus
  MISC_FEATURE (1)..(273): conserved hypothetical
VMVIRMYEQWKVRQSFVDDVNIITKLFLGIILFFFIIFVHNFDFMLYITILMLVFLLMFNGTQFKITAIFITISIGFALLSSLFMILYGNGSHTILKFGFIHITTESLVRGLHVSLRTIAISFFGILIALTSQVVMIFYSLMQHLKVKSKVAYAFMAAIRMIPLMISSLIQLRRSLKMRYQMIDAANYRGLKRFKHLIIPLLSQNIRKAHQLSVAMESKGFRDGPRTYYYNVPFSYKDIIFIIVLIAIITMAYYCSITLPITGIDDVRLGRVG

SEQ ID NO: 5069 - DNA, 1245 bp, Staphylococcus aureus
atgaatgtattagtaattggtgctggtggacgagaacatgcacttgcatataaacttaatcaatcgaatctagttaaacaagtgtttgtcattccaggtaatgaggcaatgacacctatagctgaagtacacactgaaatttcagaatctgatcatcaagcgatactagattttgctaaacggcaaaatgttgattgggtagttataggtccagaacagccgctaattgatggattagcagacattttacgagcgaatggtttcaaagtgtttggtccaaataagcaagcagctcaaatcgaaggctcaaaattatttgctaaaaagataatggaaaaatataatattccaactgctgattataaagaagttgagcgaaaaaaggatgctttaacatatattgaaaactgtgaattgcccgttgttgtcaagaaagatgggttagctgctgggaaaggcgttattattgcagatactattgaagcagccagaagtgctattgagattatgtatggtgatgaagaagaaggtactgttgtatttgaaacgtttttagaaggtgaagagttctcgctaatgacatttgttaatggtgatttagcagtacctttcgactgtattgcacaagatcataaacgcgcatttgatcatgatgaaggaccaaatactggtggtatgggggcttattgtccagtaccacatattagtgacgatgttttaaaacttacaaatgaaacaattgcacaacccattgcaaaggcaatgcttaatgaaggttatcaattcttcggtgtattatacattggtgctattttaactaaagatggtccaaaagtaatagaatttaatgcccgttttggtgatcctgaagctcaagtattattaagtcgcatggaaagtgatttaatgcagcatattattgatttagatgaaggaaaacgtactgaattcaaatggaaaaatgaatctattgtaggggtcatgttggcatcaaaaggatatcctgatgcatatgaaaaagggcataaagtaagtggctttgatttaaatgaaaactattttgttagtggattaaagaagcaaggtgatacctttgttacttcaggtggtagagttatacttgccatcggaaaaggtgacaatgtacaagatgcacagcgagacgcatacaaaaaagtatcacaaatacaaagtgaccatttattctatcgtcatgacattgcgaataaagcactacaacttaaa

SEQ ID NO: 5070 - protein, 415 aa, Staphylococcus aureus
  MISC_FEATURE (1)..(415): phosphoribosylamine-glycine
MNVLVIGAGGREHALAYKLNQSNLVKQVFVIPGNEAMTPIAEVHTEISESDHQAILDFAKRQNVDWVVIGPEQPLIDGLADILRANGFKVFGPNKQAAQIEGSKLFAKKIMEKYNIPTADYKEVERKKDALTYIENCELPVVVKKDGLAAGKGVIIADTIEAARSAIEIMYGDEEEGTVVFETFLEGEEFSLMTFVNGDLAVPFDCIAQDHKRAFDHDEGPNTGGMGAYCPVPHISDDVLKLTNETIAQPIAKAMLNEGYQFFGVLYIGAILTKDGPKVIEFNARFGDPEAQVLLSRMESDLMQHIIDLDEGKRTEFKWKNESIVGVMLASKGYPDAYEKGHKVSGFDLNENYFVSGLKKQGDTFVTSGGRVILAIGKGDNVQDAQRDAYKKVSQIQSDHLFYRHDIANKALQLK

SEQ ID NO: 5071 - DNA, 1485 bp, Staphylococcus aureus
atgtatgtgatgaagaaagctattttgagcgtatcaaataaaacaggtattgtagagtttgctaaagcgttaacgcaattaaattatgaattatattcaacaggtggtactaaacgtatattagatgaagcaaatgtaccagttcgttctgtttcagacttaacacattttccagaaataatggatggccgtgttaaaacattacatccggctgttcatggtggcattttagctgatcgaaataaaccgcagcatttaaatgaattatcagaacaacatatagatttaattgatatggtagtagttaatttatatccattccaacaaactgttgcaaaccctgatgtgacgatggacgaagcaattgaaaatattgatattggtggtccaacaatgttacgtgctgcagctaaaaactataaacatgtaacaacaattgtacatccggcagattatcaagaagtattgacgcgattaagaaacgattcgttagatgagtcatatagacaatcattaatgattaaagtttttgagcatactgcagaatatgatgaagcgattgtacgtttctttaaaggggataaagaaactttaagatatggagaaaatccacaacaatcagcgtattttgtgagaacttcgaatgctaagcacacgattgcaggcgctaaacaattacatgggaaacaattaagctataacaatattaaagatgcagatgctacactagctttagttaaaaagtttgatacacctgctacagttgcggttaaacacatgaatccatgtggtgttggtatcggtgacacgatagaacaagcatttcaacatgcgtatgaagcggatagtcaatcaatatttggtggaattgttgcattaaaccgagctgtaacacctgagttagcagagcaattgcatagtatctttttggaagtcattattgcaccaaaatttacagatgaagcattagatattttaaaacaaaagaagaatgtaagattattagaaattgatatgactatagacagtaacgaagaagagtttgtttcagtatctggcggatatttagttcaagataaagacaattatgtcgtgccaaaagaagaaatgaaagttgttacagaagtagcacctacagatgaacaatgggaagcaatgttattaggatggaaagttgtaccatcagtaaaaagtaatgcaattattttaagtaataataaacaaactgtaggtataggtgctggacaaatgaatcgtgtcggtgctgctaaaattgcgttagagagagctattgaaatcaatgatcatgtagcgttagtatctgatggatttttccctatgggagatacagttgaacttgcagcacaacatggtataaaggcaattatccaaccgggtggttcgattaaagatcaagattcaattgatatggctaataaacatggtattgcaatggtagtcacaggcactcgacattttaaacac

SEQ ID NO: 5072 - protein, 495 aa, Staphylococcus aureus
  MISC_FEATURE (1)..(495): bifunctional purine
MYVMKKAILSVSNKTGIVEFAKALTQLNYELYSTGGTKRILDEANVPVRSVSDLTHFPEIMDGRVKTLHPAVHGGILADRNKPQHLNELSEQHIDLIDMVVVNLYPFQQTVANPDVTMDEAIENIDIGGPTMLRAAAKNYKHVTTIVHPADYQEVLTRLRNDSLDESYRQSLMIKVFEHTAEYDEAIVRFFKGDKETLRYGENPQQSAYFVRTSNAKHTIAGAKQLHGKQLSYNNIKDADATLALVKKFDTPATVAVKHMNPCGVGIGDTIEQAFQHAYEADSQSIFGGIVALNRAVTPELAEQLHSIFLEVIIAPKFTDEALDILKQKKNVRLLEIDMTIDSNEEEFVSVSGGYLVQDKDNYVVPKEEMKVVTEVAPTDEQWEAMLLGWKVVPSVKSNAIILSNNKQTVGIGAGQMNRVGAAKIALERAIEINDHVALVSDGFFPMGDTVELAAQHGIKAIIQPGGSIKDQDSIDMANKHGIAMVVTGTRHFKH

SEQ ID NO: 5073 - DNA, 564 bp, Staphylococcus aureus
atggttaaaattgcgatttttgcatcaggttcaggaagtaactttgaaaatatagttgagcatgttgaatcaggaaaacttgaaaatattgaagttacggcgctatatacggatcatcaaaatgcgttttgtatagatagagcaaaaaagcacgatattcctgtttatattaatgaaccaaaacaatttgattcaaaagcagcgtatgaacaacatttagtaacattattaaatgaagataaggtagagtggattattctagctggctacatgcgtctaattggtccagacttattagcttcatttgaaggtaaaatattgaatatacatccatctctattgccgaaatataaggggattgacgcaataggccaagcatatcatagtggcgatactattactggttcgacagtacattatgttgatagtggtatggatacgggagaaattattgaacagagaaaatgtgatattagaccggacgattcaaaagaacaattagaagagaaagtaaaaaaattggaatatgagttatatccaagtgttattgctaaaattgtaaaa

SEQ ID NO: 5074 - protein, 188 aa, Staphylococcus aureus
  MISC_FEATURE (1)..(188): phosphoribosylglycinamide
MVKIAIFASGSGSNFENIVEHVESGKLENIEVTALYTDHQNAFCIDRAKKHDIPVYINEPKQFDSKAAYEQHLVTLLNEDKVEWIILAGYMRLIGPDLLASFEGKILNIHPSLLPKYKGIDAIGQAYHSGDTITGSTVHYVDSGMDTGEIIEQRKCDIRPDDSKEQLEEKVKKLEYELYPSVIAKIVK

SEQ ID NO: 5075 - DNA, 1026 bp, Staphylococcus aureus
atgtctaaagcatatgaacaatctggtgtaaatattcatgctggttatgaagctgtagaaagaatgtctagtcatgttaaacgtacgatgcgtaaagaagttatcggtggtttaggtggattcggtgctacatttgatttatcacaattaaatatgacagcgccagttttagtttctggaacagacggagtaggtacgaaattaaaactagctatcgactatggtaaacatgattcgataggtatcgatgcagtcgcaatgtgtgttaatgatattttaacgacaggtgcagaaccattatattttttagattacattgctacaaacaaagttgttcctgaagttattgaacaaattgttaaaggtattagtgatgcatgtgttgaaacgaatactgcacttatcggtggagagactgctgaaatgggtgaaatgtatcacgaaggcgaatatgatgtagctggatttgctgttggagcagttgaaaaggatgactatgtagatggttcagaagtgaaagagggacaagttgttatagggcttgcgtcaagtggcattcattcaaatggatacagtttagtgcgcaaattaattaatgaatcaggcattgatttggcatcaaacttcgataatcgtccatttatcgatgtctttttagaaccaactaaattatatgtcaaacctgtacttgctttgaaaaaagaagtttctattaaggcaatgaatcatattactggtggaggtttttatgaaaatattccacgtgcattgccagccggatatgctgctagaattgatactacatcatttccaacaccaaaaatatttgattggttacaacaacaaggcaatatagacacaaatgaaatgtataacatttttaatatgggtattggctatacggttatcgttgatgaaaaagatgtatcacgcgctttgaagattttagcagaacaaaatgtggaagcctatcaaattggtcatattgtgaaaaatgagtcaactgcaattgaattgttgggggta

SEQ ID NO: 5076 - protein, 342 aa, Staphylococcus aureus
MSKAYEQSGVNIHAGYEAVERMSSHVKRTMRKEVIGGLGGFGATFDLSQLNMTAPVLVSGTDGVGTKLKLAIDYGKHDSIGIDAVAMCVNDILTTGAEPLYFLDYIATNKVVPEVIEQIVKGISDACVETNTALIGGETAEMGEMYHEGEYDVAGFAVGAVEKDDYVDGSEVKEGQVVIGLASSGIHSNGYSLVRKLINESGIDLASNFDNRPFIDVFLEPTKLYVKPVLALKKEVSIKAMNHITGGGFYENIPRALPAGYAARIDTTSFPTPKIFDWLQQQGNIDTNEMYNIFNMGIGYTVIVDEKDVSRALKILAEQNVEAYQIGHIVKNESTAIELLGV

SEQ ID NO: 5077 - DNA, 1503 bp, Staphylococcus aureus
atgggaaggggcaattgctcaatgtttaactactcaggattaaacgaagaatgtggcgtgtttggtatttggaatcatcctgaagcagcgcaactaacatatatgggacttcatagtttgcaacatcgtggtcaagaaggtgcaggtatagttgtttctgatcaaaatgaattaaaaggcgagcgaggattaggcttactaactgaagcgattaaagatgatcaaatggaacgattaaaaggatatcaacatgcaattggtcacgtccgttatgctacttcaggtaataaaggtattgaaaatattcaaccgtttctgtatcacttttatgatatgagtgtaggtatttgtcataatggtaacctcattaatgctaaatcattgcgtcagaatttagaaaaacaaggtgctatcttccattcgtcttctgatactgaagtcattatgcatttgatacgtcgaagtaaagctcctacttttgaggaagcgttgaaagaaagtttgcgaaaagttaaaggcggttttacatttgcgattttaactaaagatgcgttatatggcgcagtagatccaaatgctatcagaccacttgttgtaggtaaaatgaaagatgggacatacatccttgcaagtgaaacatgtgcaatagatgtgttaggtgcagaatttgttcaagatattcatgcaggtgaatatgtcgtgattaacgataaaggtattacagttaaatcttatacacatcatacgacaactgcaatttctgcgatggaatatatttattttgctagaccagactcaacaatagctggtaaaaatgtccatgcagtacgtaaagcttctggtaaaaaattagcccaagaaagccctgtaaatgctgatatggtcatcggtgtacccaattcatcgctatcagctgcgagtggttatgctgaagaaataggtttgccatatgaaatgggactagttaaaaatcaatatgttgcaagaacatttattcaaccaactcaagaattacgtgagcaaggtgtgagagtgaagttatctgcggtaaaagatatagtagatgggaaaaatatcattcttgttgatgattccattgttcgcggtacgacaattcgacgcattgtgaaaatgttaaaagattctggtgcaaataaagtgcatgtgcgtatagcatcaccggaatttatgtttccaagtttttacggaatcgatgtttcaactacggcagaattaatttctgcaagcaaatcacctgaagaaattaaagattatattggcgctgattcattagcatatctatctgtagatgggttaattgaatcaattggtttagattatgacgcgccatatagtggcttatgtgtagaaagtttcactggagattatcctgcagggttatatgattatgaagcaaattataaagcgcatttaagtcatcgacaaaagcaatatatttctaaaaacaaacacttttttgatagcgagggaaatttaaatgtc

SEQ ID NO: 5078 - protein, 501 aa, Staphylococcus aureus
  MISC_FEATURE (1)..(501): phosphoribosylpyrophosphate
MGRGNCSMFNYSGLNEECGVFGIWNHPEAAQLTYMGLHSLQHRGQEGAGIVVSDQNELKGERGLGLLTEAIKDDQMERLKGYQHAIGHVRYATSGNKGIENIQPFLYHFYDMSVGICHNGNLINAKSLRQNLEKQGAIFHSSSDTEVIMHLIRRSKAPTFEEALKESLRKVKGGFTFAILTKDALYGAVDPNAIRPLVVGKMKDGTYILASETCAIDVLGAEFVQDIHAGEYVVINDKGITVKSYTHHTTTAISAMEYIYFARPDSTIAGKNVHAVRKASGKKLAQESPVNADMVIGVPNSSLSAASGYAEEIGLPYEMGLVKNQYVARTFIQPTQELREQGVRVKLSAVKDIVDGKNIILVDDSIVRGTTIRRIVKMLKDSGANKVHVRIASPEFMFPSFYGIDVSTTAELISASKSPEEIKDYIGADSLAYLSVDGLIESIGLDYDAPYSGLCVESFTGDYPAGLYDYEANYKAHLSHRQKQYISKNKHFFDSEGNLNV

SEQ ID NO: 5079 - DNA, 2187 bp, Staphylococcus aureus
atgtctaaatttatcgaaccaagcgttgaagaaattaaacttgaaaaagtatatcaagatatgggattaagtgatcaagaatatgaaaaagtttgcgatattttaggcagacaacctaactttacagaaacaggtatcttttctgttatgtggagtgaacattgctcttataaacattctaaaccgtttttaaagcaatttcctacgtcaggtgaccatgtgcttatggggcctggtgaaggtgcaggggtagtcgatataggtgataatcaagccgtagtatttaaagtagagtctcacaatcatccatcagcaattgaaccatatcaaggggctgctacaggcgttggtggaatcattcgtgacattgtctctattggggctagacctattaatttgttaaacagtcttagatttggagaattagataataaacaaaaccaaagattacttaaaggtgttgtaaagggtatcggaggttatggtaactgcattggtattccaacaactgctggtgaaatcgaatttgatgaacgttatgatggcaatccacttgttaatgcaatgtgtgttggtgttatcaatcacgacatgattcaaaaaggcacagcaaaaggtgtaggtaattcggtcatttatgttggtttgaaaactggtcgagatggtattcatggtgctacttttgcatctgaagaattgacggaagaaagcgaaagtaaacgaccttctgtacaaatcggtgatccatttgtaggtaaaaaattaatggaagcaacacttgaagcaattacatttgatgaattagttggtattcaagatatgggtgctgctggtttaacatcttcatcgtctgaaatggcggcaaaaggtggtagtgggttacatttgagattagaacaagtgccaacacgtgagccaggtatttctccttatgaaatgatgctttcagaaactcaagaacgtatgttactagttgttgaaaaaggtactgaacaaaaattcttagatttatttgataagcacgaattggatagtgctgttataggtgaagttacagatacaaatcgttttgttttaacatatgatgacgaagtttatgctgacattccagttgaaccactagctgatgaagcacctgtatatattttagaaggagaagaaaaagattataatacttctaaaaatgattatacacacatcgatgttaaagatactttctttaaattacttaagcatccgactatagcatctaaacactatttatatgatcaatacgaccaacaagttggtgccaatacgataattaagccaggacttcaagcatcggtagtacgtgtggaaggcacaaataaggcaattgcttcaacaattgatggtgaagcgcgttatgtatataacaatccatatgaaggtggaaagatggtagtagctgaagcttatcgaaatttaattgccgtgggtgcaacaccattagcaatgacagattgtttaaattatggttctcctgaaaagaaagaaatctatcaacagttgatagattcaacgaaaggtatggcagaagcatgcgacattcttaagacaccagtagtttctggtaatgtatctttatataacgaaacgaaaggtacttctattttcccaacaccagttgttggaatggtaggtttgattgaaaatgtaaattatttaaatgattttgaacctcaagttggagataaattatatttaatcggtgatactaaggacgactttggtggtagtcaacttgaaaagttaatttatggcaaagttaatcatgaatttgagtcattagatttgagttcagaagttgaaaaaggtgaatcaatcaagaccgctattcgtgaaggactattatcacatgttcaaacagttggtaaaggtggcttactgattaccttagctaaactaagtgcgcattacggtttaggattaaaatcttcaatagatataacaaatgcacaattgtttagtgagacgcaaggccgatatgttgtttctgttaaatcaggtaaaactttaaatattgataatgcaatagaaattggacttttaacagatagtgataatttcaaggtaacaacaccatatacagagattagtgaaaatgtttcagatattaaacaaatatgggaaggggcaattgctcaatgtttaactactcaggat

SEQ ID NO: 5080 - protein, 729 aa, Staphylococcus aureus
MSKFIEPSVEEIKLEKVYQDMGLSDQEYEKVCDILGRQPNFTETGIFSVMWSEHCSYKHSKPFLKQFPTSGDHVLMGPGEGAGVVDIGDNQAVVFKVESHNHPSAIEPYQGAATGVGGIIRDIVSIGARPINLLNSLRFGELDNKQNQRLLKGVVKGIGGYGNCIGIPTTAGEIEFDERYDGNPLVNAMCVGVINHDMIQKGTAKGVGNSVIYVGLKTGRDGIHGATFASEELTEESESKRPSVQIGDPFVGKKLMEATLEAITFDELVGIQDMGAAGLTSSSSEMAAKGGSGLHLRLEQVPTREPGISPYEMMLSETQERMLLVVEKGTEQKFLDLFDKHELDSAVIGEVTDTNRFVLTYDDEVYADIPVEPLADEAPVYILEGEEKDYNTSKNDYTHIDVKDTFFKLLKHPTIASKHYLYDQYDQQVGANTIIKPGLQASVVRVEGTNKAIASTIDGEARYVYNNPYEGGKMVVAEAYRNLIAVGATPLAMTDCLNYGSPEKKEIYQQLIDSTKGMAEACDILKTPVVSGNVSLYNETKGTSIFPTPVVGMVGLIENVNYLNDFEPQVGDKLYLIGDTKDDFGGSQLEKLIYGKVNHEFESLDLSSEVEKGESIKTAIREGLLSHVQTVGKGGLLITLAKLSAHYGLGLKSSIDITNAQLFSETQGRYVVSVKSGKTLNIDNAIEIGLLTDSDNFKVTTPYTEISENVSDIKQIWEGAIAQCLTTQD

SEQ ID NO: 5081 - DNA, 693 bp, Staphylococcus aureus
atgatgaaaaggagaatgcataaaatgaaatttgcggttcttgtttttccaggttcgaattgtgatagagacatgtttaatgctgctattaaaagtggtgttgaagcggaatatgtagattatagagaaacatcactaagtggatttgatggcgtacttattcctggtggattttcattcggggattacttaagatctggggcaatggctagtgtagcgccgattatttcggaagttaaacgtcttgcagctgaaggtaagccagtattaggtgtttgtaatgggtttcaaattttaactgaaataggcttattacctggtgcattattgcataacgattcacatttatttattagtagaaatgaagagttagaaatagtgaataatcaaacggcatttacaaatctttatgaacaaggtgaaaaagttatatatcctgtagctcacggtgaaggtcattattattgtactgatgaaatatatcaacaattaaaagctaacaatcaaattattctgaaatatgtgaataatccgaacggttcatatgatgatattgcaggaattgttaacgaaaaaggcaatgtatgtggcatgatgccacatcctgaaagagctttagaaacgttgttaggtactgatagtggtgtgaaattatttgaagcgatggtaaaaagttggagggaacaacatgtc

SEQ ID NO: 5082 - protein, 231 aa, Staphylococcus aureus
MMKRRMHKMKFAVLVFPGSNCDRDMFNAAIKSGVEAEYVDYRETSLSGFDGVLIPGGFSFGDYLRSGAMASVAPIISEVKRLAAEGKPVLGVCNGFQILTEIGLLPGALLHNDSHLFISRNEELEIVNNQTAFTNLYEQGEKVIYPVAHGEGHYYCTDEIYQQLKANNQIILKYVNNPNGSYDDIAGIVNEKGNVCGMMPHPERALETLLGTDSGVKLFEAMVKSWREQHV

SEQ ID NO: 5083 - DNA, 261 bp, Staphylococcus aureus
atgaaaacaattgaactacatatcacattacaaccacaagtattagatacgcaaggacaaacgcttactcgagctgtacatgacttaggttatgcacaagtgaatgatattcgtgtaggaaaagtattatatatgacagtggatgaggttagtgatgaaaaggtacacaacattattacaactctaagtgaaaaattgtttgcaaatacagtgattgaagaatatagctataaagtgttagatgatgaaaaggagaatgca

SEQ ID NO: 5084 - protein, 87 aa, Staphylococcus aureus
  MISC_FEATURE (1)..(87): conserved hypothetical
MKTIELHITLQPQVLDTQGQTLTRAVHDLGYAQVNDIRVGKVLYMTVDEVSDEKVHNIITTLSEKLFANTVIEEYSYKVLDDEKENA

SEQ ID NO: 5085 - DNA, 558 bp, Staphylococcus aureus
  MISC_FEATURE (1)..(558): n = g, a, t, or c
ttgagaggcgaccaacgaacacagggtgaaaaatcaagaaaagaaggtggaaaaatatttggatcaggaagtagagcaccgatagctatatctattttagttaaagatggaagttacaatcacgatatctattataatgacattggtgaatatttaactagagagcaaaaattagatactttaatgaaacatcaatcaattgtgaatttgaaaagtttgaatgttttacccgataaaaacaatgattggattaatcaacgagacataaactatgagaattatttaccaatgtatgattccaaggatattgaaaattctatatatttagatcaatttaatggagtaaattcagcaagagataattgggtaacaaatttttcgaatgaaaaagcattagtaaatgcaaaattacttgtagataactataattctgaaatagatagattaattgatatcttagattctggagaacgtataaatttagtgaactcagatgaaacatttatttattgtactcgagtactcacccaatattttttaaaagaaaaaatttnnnnn

SEQ ID NO: 5086 - protein, 186 aa, Staphylococcus aureus
  MISC_FEATURE (1)..(186): Xaa = any amino acid
LRGDQRTQGEKSRKEGGKIFGSGSRAPIAISILVKDGSYNHDIYYNDIGEYLTREQKLDTLMKHQSIVNLKSLNVLPDKNNDWINQRDINYENYLPMYDSKDIENSIYLDQFNGVNSARDNWVTNFSNEKALVNAKLLVDNYNSEIDRLIDILDSGERINLVNSDETFIYCTRVLTQYFLKEKIXX

SEQ ID NO: 5087 - DNA, 702 bp, Staphylococcus aureus
atgacattattatatgaaggaaaagcgaagcgcattttctcaacaaatcaagaaaatgaattaagagttgaatataaagatgaagttactgctggaaacggggctaagaaagacacaatggcaggtaaggggcgattaaataatcaaattacttctattatatttaaatatttacaagaaaatggaatagaaagtcactttattaaacaattatctgaaacagaacaattagttaagcctgtgaaaataattccattagaagtagttgttcgtaatattgctagtggatctattacaaagcgtttaggttttgaaaatggtgaagtttttagagaaccacttgtagaatttttctataaaaatgatgcgttaaatgatccgttgataacggatgaccatgttaaattgctcaatatagcatcagatgaagatattgaaatactaaaatccaaagcattaaagattaataatgtgttgaaacaattaatggatgctatgaatttaaaattagtagattttaaaatcgaatttggaaagactgagactggtcaaattttgttagcggatgaaatatctccagatacatgtcgaatttgggataaagctaccaatgcaaactttgataaagatgtatatagaaataacactggatcactgattgaaacatatcaaatatttttaaacaaattggaggatttaaaa

SEQ ID NO: 5088 - protein, 234 aa, Staphylococcus aureus
MTLLYEGKAKRIFSTNQENELRVEYKDEVTAGNGAKKDTMAGKGRLNNQITSIIFKYLQENGIESHFIKQLSETEQLVKPVKIIPLEVVVRNIASGSITKRLGFENGEVFREPLVEFFYKNDALNDPLITDDHVKLLNIASDEDIEILKSKALKINNVLKQLMDAMNLKLVDFKIEFGKTETGQILLADEISPDTCRIWDKATNANFDKDVYRNNTGSLIETYQIFLNKLEDLK

SEQ ID NO: 5089 - DNA, 1122 bp, Staphylococcus aureus
atgaacttcaataaattaaagtttggtgcgactattggcattattggtggtggtcagcttggaaagatgatggcacaatcagctcaaaaaatgggttataaagtggttgtattggatccttctgaagattgtccatgtagatacgttgcacacgaatttatacaagccaagtatgacgatgaaaaggcactcaatcaattaggacaaaaatgtgatgtgattacttatgaatttgaaaacatttcagcccaacaattaaaactattatgtgaaaagtacaatattccgcaaggttaccaagctatacagttattacaagatcgcttaactgaaaaagaaacattaaaaagtgctggtaccaaagttgtcccgttcatttcagtaaaagaatctacagatattgacaaagcaattgaaacattaggatatccttttattgtaaaaactagatttggtggctacgatggcaaaggtcaagttttaattaacaacgaaaaagacttacaagaaggttttaaattaattgaaactagtgaatgcgtagctgaaaaatatttgaatatcaagaaagaagtatctcttactgttacaagaggaaacaacaatcaaatcacttttttcccattacaagaaaatgagcatagaaatcaaatacttttcaaaacaattgttccagcgagaatagataaaacagctgaggcgaaagagcaagttaataaaattatccaatcgattcatttcattggaacatttacagttgaattttttatagatagtaacaaccaattgtatgtgaacgagatagcaccaaggcctcacaattccggacattattcaattgaagcatgtgattattcacaatttgatactcatattttagcagttaccggacaatcattaccaaattcaattgaattattaaagccagcagtcatgatgaacttactaggtaaagatttagatttattggaaaatgaatttaatgaacatccagagtggcacttacatatttatggtaagtctgagcgtaaagatagcagaaaaatggggcatatgactgtactaacgaatgatgtaaaccaaactgaacaagatatgtacgctaaatttgaggggagtaat

SEQ ID NO: 5090 - protein, 374 aa, Staphylococcus aureus
MNFNKLKFGATIGIIGGGQLGKMMAQSAQKMGYKVVVLDPSEDCPCRYVAHEFIQAKYDDEKALNQLGQKCDVITYEFENISAQQLKLLCEKYNIPQGYQAIQLLQDRLTEKETLKSAGTKVVPFISVKESTDIDKAIETLGYPFIVKTRFGGYDGKGQVLINNEKDLQEGFKLIETSECVAEKYLNIKKEVSLTVTRGNNNQITFFPLQENEHRNQILFKTIVPARIDKTAEAKEQVNKIIQSIHFIGTFTVEFFIDSNNQLYVNEIAPRPHNSGHYSIEACDYSQFDTHILAVTGQSLPNSIELLKPAVMMNLLGKDLDLLENEFNEHPEWHLHIYGKSERKDSRKMGHMTVLTNDVNQTEQDMYAKFEGSN

SEQ ID NO: 5091 - DNA, 489 bp, Staphylococcus aureus
gtgtacaaagtgaaagtagcagtcattatgggcagttcttccgattggaaaattatgcaagagagttgtaacatgttggattattttgaaattccgtacgaaaaacaagtagtatccgcacatcgtacgccaaaaatgatggttcaatttgcttctgaagcgagagaaagaggtataaacattatcattgcaggcgctggcggtgcggcacatttaccaggtatggttgcatcattaacgacgctaccagttattggagtgccgattgaaacaaaaagtttaaagggtatagattctttattatcaattgttcaaatgccaggaggtattccggttgcaacgactgcaattggtgcagcaggtgctaaaaacgcaggtatacttgcagcaagaatgttaagtattcaaaatccttctttagttgaaaaactaaatcagtatgaatcttcgttaattcaaaaagtggaggacatgcaaaatgaacttcaa

SEQ ID NO: 5092 - protein, 163 aa, Staphylococcus aureus
  MISC_FEATURE (1)..(163): hypothetical protein
VYKVKVAVIMGSSSDWKIMQESCNMLDYFEIPYEKQVVSAHRTPKMMVQFASEARERGINIIIAGAGGAAHLPGMVASLTTLPVIGVPIETKSLKGIDSLLSIVQMPGGIPVATTAIGAAGAKNAGILAARMLSIQNPSLVEKLNQYESSLIQKVEDMQNELQ

SEQ ID NO: 5093 - DNA, 882 bp, Staphylococcus aureus
ttgacaataggaggagaagtttttatggttgctaaaattttagatggtaaacaaattgccaaagactacagacaggggttacaagatcaagttgaagcgctaaaagaaaagggttttacacctaaattatccgttatattagttggtaatgatggcgctagtcaaagttatgttagatcaaaaaagaaagcagctgaaaaaattggtatgatttcagaaatcgtacatttggaagaaacagctactgaagaagaagtattaaacgaactaaatagactaaataatgatgattctgtaagtggtattttggtacaagtaccattaccaaaacaagttagcgaacagaaaatattagaagcaatcaatcctgaaaaagatgtggacggttttcatccaataaatatagggaaattatatatcgatgaacaaacttttgtaccttgcacaccgctcggcatcatggaaatattaaaacatgctgatattgatttagaaggtaaaaatgcagttgtaattggacgaagtcatattgtcggacaaccagtttctaagttactacttcaaaaaaatgcatcagtaacaatcttacattctcgttcaaaagatatggcatcatatttaaaagatgctgatgtcattgtcagtgcagttggtaagcctggtttagtaacaaaagatgtggtcaaagaaggagcagtaattatcgatgttggcaatacgccagatgaaaatggcaaattaaaaggtgacgttgattatgatgcggttaaagaaattgctggagctattacaccagttcctggtggcgttggtccattaacaattactatggtattaaataatactttgcttgcagaaaaaatgcgtcgaggtattgattcg

SEQ ID NO: 5094 - protein, 294 aa, Staphylococcus aureus
  MISC_FEATURE (1)..(294): FolD bifunctional protein
LTIGGEVFMVAKILDGKQIAKDYRQGLQDQVEALKEKGFTPKLSVILVGNDGASQSYVRSKKKAAEKIGMISEIVHLEETATEEEVLNELNRLNNDDSVSGILVQVPLPKQVSEQKILEAINPEKDVDGFHPINIGKLYIDEQTFVPCTPLGIMEILKHADIDLEGKNAVVIGRSHIVGQPVSKLLLQKNASVTILHSRSKDMASYLKDADVIVSAVGKPGLVTKDVVKEGAVIIDVGNTPDENGKLKGDVDYDAVKEIAGAITPVPGGVGPLTITMVLNNTLLAEKMRRGIDS

SEQ ID NO: 5095 - DNA, 315 bp, Staphylococcus aureus
atgaataaactattacagtcattatcagccctcggtgtttctgctacactagtaacaccaaatttaaatgcagatgcaacgacgaatactacaccacaaattaaaggcgctaatgatatcgttattaagaaaggtcaagattataaccttctaaacggcataagtgcatttgataaagaagatggagatttaaccgataaaattaaagtcgatggccaaattgatacatctaaatctggtaaatatcaaattaaatatcatgtcactgattcagatggtgcaattaaaatttccactaggtatattgaggttaaa

SEQ ID NO: 5096 - protein, 105 aa, Staphylococcus aureus
  MISC_FEATURE (1)..(105): hypothetical protein
MNKLLQSLSALGVSATLVTPNLNADATTNTTPQIKGANDIVIKKGQDYNLLNGISAFDKEDGDLTDKIKVDGQIDTSKSGKYQIKYHVTDSDGAIKISTRYIEVK

SEQ ID NO: 5097 - DNA, 120 bp, Staphylococcus aureus
ttgattgaaaggaagcgcaaacattttaataaggaatttgccaaaagtaatttatcgttaaacaatgaaaagtggaaatttgtttgttcaaaatcaaaacatttttttaaaaagagcagt

SEQ ID NO: 5098 - protein, 40 aa, Staphylococcus aureus
LIERKRKHFNKEFAKSNLSLNNEKWKFVCSKSKHFFKKSS

SEQ ID NO: 5099 - DNA, 1098 bp, Staphylococcus aureus
gtgtcaaaatttaagtctttgcttctattatttggcacactaattttacttagtggttgttcaaatatagaaattttcaacgcaaaagggccagtagcaagtagtcagaagttcttgattctttattcaatcgtcttcatgcttgttatttgtttcgttgtacttggcatgttcgccatttttatttacaagtatagttataataagaatgccgaatctggtaagatgcaccataatgccatcattgaaacaatatggtttgtaatacctatcataatcgttgctgctttagctattcctacagttaaaactttatacgattacgaaaaaccaccgaagagtgagaaagatccaatggttgtatatgcagtaagtgcaggatacaaatggttctttgcttatccagatgaacatatagagactgttaatacattaacaatccctaaagatcgtcctgttgtatttaagcttcaagctatggatacaatgacaagtttctggattccacaattaggtggtcaaaaatatgccatgactggcatgacaatgaattggacgttagaagcatctcaaactggtacgttcagaggtcgtaactctaacttcaatggtgaaggattctcacgtcaaacatttaaagtaaatgccgttagtcaaaaagactacgacaaatgggtgaaagaagttaaaggtaagaaaacgttagatcaagatacatttgataaacaattattaccaagcacacctaataaagctttagaatttaatggtacacatatggcgtttgttgatccagcagccgatccagaatacatcttctatgcatataaacgtttcaatttcgaattgaaagatccaaacttcactagtgaagaaaatatgtttaaagatgtatcagacaaaccattaatacctgctcgtaaagctcaaattacaaatgcgaactataaacgacatggtatgaagttgatgattcttggaaatgacgaaccatataacaatgagttcaagaaagatgaatcgaaaaatgcgaaagaaatgaagaaaatttcaaaagatgcgcaagatcaagacaatgatgatcatggaggtggacat

SEQ ID NO: 5100 - protein, 366 aa, Staphylococcus aureus
  MISC_FEATURE (1)..(366): hypothetical protein
VSKFKSLLLLFGTLILLSGCSNIEIFNAKGPVASSQKFLILYSIVFMLVICFVVLGMFAIFIYKYSYNKNAESGKMHHNAIIETIWFVIPIIIVAALAIPTVKTLYDYEKPPKSEKDPMVVYAVSAGYKWFFAYPDEHIETVNTLTIPKDRPVVFKLQAMDTMTSFWIPQLGGQKYAMTGMTMNWTLEASQTGTFRGRNSNFNGEGFSRQTFKVNAVSQKDYDKWVKEVKGKKTLDQDTFDKQLLPSTPNKALEFNGTHMAFVDPAADPEYIFYAYKRFNFELKDPNFTSEENMFKDVSDKPLIPARKAQITNANYKRHGMKLMILGNDEPYNNEFKKDESKNAKEMKKISKDAQDQDNDDHGGGH

SEQ ID NO: 5101 - DNA, 1986 bp, Staphylococcus aureus
atgaattttccatgggatcaattactagttaaaggtaactggatgattacaatggcacaaattggtgccccattcttagttattggtttaatcgcagtaattacttactttaaattatggaaatatctttacaaagaatggttcacatctgtagaccataagaaaatcggtattatgtatttaatctgtgccgtattaatgttcgtccgtggtggtattgatgcgttacttattcgtgcgcaattaacagtacctgataacaaatttttagaatctaaccactataacgaaatttttagtacacatggtgtaatcatgattatcttcatggcaatgccatttatctttggtttatggaatatcgttgttccattacaaattggagcacgtgatgttgcattcccagtattaaacaacgtaagtttctggctattctttgcaggtatgattttattcaacctgtcatttattattggtggttcaccagcagctggttggacaaactatgcgccactagcaggtgaattcagtcctggtccgggtgttaactattacttaatagctatacaaatttcagggcttggtaccttagctacaggtatcaacttctttgtaacaattttaagatgtaaaacaccaactatgaagtttatgcaaatgccaatgtttacagtaacaacatttattactacattaattgttattcttgctttccctcctttaacagtagcgttagcattaatgacaactgatagaatatttgacacagcattcttcacagttgcacatggcggtatgccaatgctttgggctaacttcttctgggtatgggggcaccctgaagtttatatcgttatccttccagcatttggtatttactcagaaattatcccgacattcgctcgtaagcgtttattcggacatcaaagtatggtatgggcaactgccggtatcgcgttccttagtttcttagtttgggttcaccatttcttcacaatgggtaatggtgcgttaatcaactcattcttctcaatttcaacaatgctgattggtattccaactggtgtgaaattgtttaactggttattaacattatataaaggacgtattacatttgagtcaccaatgctattctcattagcatttatccctaacttccttttaggtggtgttacgggtgtaatgttagcaatggcatcagctgactatcaatatcacaatacgtacttcttagtagctcacttccactatacattggttactggtgttgtatttgcctgcttagctggtttaatcttctggtatccaaagatgatgggttacaaattaaacgaaacattaaacaaatggtgcttctggttcttcatgatcggatttaacgtttgtttcttaccacaattcattcttggattagatggtatgccacgtcgtttatacacttatatgccatcagatggttggttcttattaaacttaatttcaactatcggtgcattattaatggcaatcggattcttattccttgttgttagtatcgtatacagtcacttcaaatctccacgtgaagcaactggagataactgggatggccttggtcgtactctagagtggactactgcatcagcaattccacctaaatacaactttgccattacaccagattggaatgactacgacacatttgttgatatgaaagaacatggtcgtcattacttagacaaccataattacaaagacattcatatgccaaacaatactcctgttggattctggattggtatctttatgactatcggcggtttcttcttaattttcgaaactgtaattccagcattaatttgtttattcggtatttttggtactatgatttatcgcagtttccaaatcgatcacggatatcatatccctgctgctgaagttgcagaaactgaagctagattaagagaagcgcgtattaaagaaagggaggctgtaagtcatgagtca

SEQ ID NO: 5102 - protein, 662 aa, Staphylococcus aureus
  MISC_FEATURE (1)..(662): Quinol oxidase polypeptide
MNFPWDQLLVKGNWMITMAQIGAPFLVIGLIAVITYFKLWKYLYKEWFTSVDHKKIGIMYLICAVLMFVRGGIDALLIRAQLTVPDNKFLESNHYNEIFSTHGVIMIIFMAMPFIFGLWNIVVPLQIGARDVAFPVLNNVSFWLFFAGMILFNLSFIIGGSPAAGWTNYAPLAGEFSPGPGVNYYLIAIQISGLGTLATGINFFVTILRCKTPTMKFMQMPMFTVTTFITTLIVILAFPPLTVALALMTTDRIFDTAFFTVAHGGMPMLWANFFWVWGHPEVYIVILPAFGIYSEIIPTFARKRLFGHQSMVWATAGIAFLSFLVWVHHFFTMGNGALINSFFSISTMLIGIPTGVKLFNWLLTLYKGRITFESPMLFSLAFIPNFLLGGVTGVMLAMASADYQYHNTYFLVAHFHYTLVTGVVFACLAGLIFWYPKMMGYKLNETLNKWCFWFFMIGFNVCFLPQFILGLDGMPRRLYTYMPSDGWFLLNLISTIGALLMAIGFLFLVVSIVYSHFKSPREATGDNWDGLGRTLEWTTASAIPPKYNFAITPDWNDYDTFVDMKEHGRHYLDNHNYKDIHMPNNTPVGFWIGIFMTIGGFFLIFETVIPALICLFGIFGTMIYRSFQIDHGYHIPAAEVAETEARLREARIKEREAVSHES

SEQ ID NO: 5103 - DNA, 396 bp, Staphylococcus aureus
atgactttggcacaagttgaatatagaggcacaggccgtcgtaaaaactcagtagcacgtgtacgtttagtaccaggtgaaggtaacatcacagttaataaccgtgacgtacgcgaatacttaccattcgaatcattaattttagacttaaaccaaccatttgatgtaactgaaactaaaggtaactatgatgttttagttaacgttcatggtggtggtttcactggacaagctcaagctatccgtcacggaatcgctcgtgcattattagaagcagatcctgaatacagaggttctttaaaacgcgctggattacttactcgtgacccacgtatgaaagaacgtaaaaaaccaggtcttaaagcagctcgtcgttcacctcaattctcaaaacgt

SEQ ID NO: 5104 - protein, 132 aa, Staphylococcus aureus
  MISC_FEATURE (1)..(132): 30S ribosomal protein S9
MTLAQVEYRGTGRRKNSVARVRLVPGEGNITVNNRDVREYLPFESLILDLNQPFDVTETKGNYDVLVNVHGGGFTGQAQAIRHGIARALLEADPEYRGSLKRAGLLTRDPRMKERKKPGLKAARRSPQFSKR

SEQ ID NO: 5105 - DNA, 603 bp, Staphylococcus aureus
atgagtcatgatacaaacactattgattcacgcacacatgaaggcgaattaaataagcttggcttttggattttcattacagccgaatttgcgttattcggtaccctatttgcgacactattaactttgcaacatggtggcgattatgcaggtaaaatgactactgagttatttgaattgcctcttgttttaataatgacgtttgcattattattcagttcttacacatgtggtattgctatttactacatgcgccaagaaaaacaaaagttaatgatgttttggatgatcattacgttacttttaggtttagtctttgttggattcgaaatttatgaattcgcacactatgcatcagaaggcgttaacccaacaattggttcttactggtctagtttctttatcctattaggaacgcatggttgtcacgtatcgctaggtatcgtttgggccatttgtttattaatccaaatccaacgacgcggattagacaaatataatgcgccaaaattatttatagtaagtttatactggcacttcttagatgttgtttgggttttcatctttactgccgtatatatgatagggatggtgtatagcgga

SEQ ID NO: 5106 - protein, 201 aa, Staphylococcus aureus
  MISC_FEATURE (1)..(201): Quinol oxidase polypeptide
MSHDTNTIDSRTHEGELNKLGFWIFITAEFALFGTLFATLLTLQHGGDYAGKMTTELFELPLVLIMTFALLFSSYTCGIAIYYMRQEKQKLMMFWMIITLLLGLVFVGFEIYEFAHYASEGVNPTIGSYWSSFFILLGTHGCHVSLGIVWAICLLIQIQRRGLDKYNAPKLFIVSLYWHFLDVVWVFIFTAVYMIGMVYSG

SEQ ID NO: 5107 - DNA, 288 bp, Staphylococcus aureus
atgagtacaataatgaaacatactgtaggatttatcgcatctatcgtattaacgcttttagcagtttacgtaacactatacacgtcattaacattccacgcgaagttgacaattatctttggctttgcattcgtccaagcaggacttcaattattaatgttcatgcatttaactgaaggtaaagatggacgtttacaaacattcaaagttatctttgctcttgtaattacactttgtttcgttgtcggaacatattgggttatgcaaggcggtcactcttcacactta

SEQ ID NO: 5108 - protein, 96 aa, Staphylococcus aureus
  MISC_FEATURE (1)..(96): hypothetical protein
MSTIMKHTVGFIASIVLTLLAVYVTLYTSLTFHAKLTIIFGFAFVQAGLQLLMFMHLTEGKDGRLQTFKVIFALVITLCFVVGTYWVMQGGHSSHL

SEQ ID NO: 5109 - DNA, 1191 bp, Staphylococcus aureus
atgaaatttaataaagtaaaactagttatacatgcgtgtgtactattatttatcattatttctatagcgttaatttttcatcgattacagacgaagacacattctatagacccaatacataaggaaacaaaattatcagacaatgaaaaatatttagtggatcgtaataaggaaaaggttgcgccgtctaaactaaaagaggtatataatagcaaggatcctaaatataagaaaattgacaagtatttacaaagttcattatttaacggttcagtagctatatatgaaaatggcaaattgaaaatgagtaaaggttatggatatcaagattttgaaaaaggtattaaaaacacaccgaatacgatgtttttaataggttcagctcaaaaattttcaacagggttactgttaaaacagttagaagaagaacataaaataaatatcaatgatccagtaagtaaataccttccatggtttaaaacatctaagcctatcccattgaaagatttaatgttgcatcaaagtggattatataaatataaatcctcaaaagattataaaaatttagatcaagcagttaaagcgattcaaaaacgtggtattgatcctaagaaatacaaaaagcatatgtataacgatgggaattatttagtacttgcgaaagtaattgaagaagttacaggtaaatcttatgctgagaattattatacaaaaataggagatcctttaaaacttcagcacacagcattttatgatgaacaaccttttaaaaaatatctagcaaaaggttatgcttataatagtacaggactttcattcttaagacctaatattttggaccaatactatggtgcaggtaatttatatatgacaccaacagatatgggtaaattaattactcaaatacaacaatataaattattcagtcctaaaataaccaatccattattacatgagtttggtacgaaaaagtatccagatgaatatcgatatggtttctatgctaagccaacattgaatagacttaacgggggattctttggacaagtctttactgtttactataatgataagtatgtagttgtacttgcattaaatgtaaaaggaaacaatgaagttcgaatcaaacatatttataatgatattttaaaacaaaataaaccttacaatacgaagggtgttattgttcaa

SEQ ID NO: 5110 - protein, 397 aa, Staphylococcus aureus
  MISC_FEATURE (1)..(397): autolysis and methicillin
MKFNKVKLVIHACVLLFIIISIALIFHRLQTKTHSIDPIHKETKLSDNEKYLVDRNKEKVAPSKLKEVYNSKDPKYKKIDKYLQSSLFNGSVAIYENGKLKMSKGYGYQDFEKGIKNTPNTMFLIGSAQKFSTGLLLKQLEEEHKININDPVSKYLPWFKTSKPIPLKDLMLHQSGLYKYKSSKDYKNLDQAVKAIQKRGIDPKKYKKHMYNDGNYLVLAKVIEEVTGKSYAENYYTKIGDPLKLQHTAFYDEQPFKKYLAKGYAYNSTGLSFLRPNILDQYYGAGNLYMTPTDMGKLITQIQQYKLFSPKITNPLLHEFGTKKYPDEYRYGFYAKPTLNRLNGGFFGQVFTVYYNDKYVVVLALNVKGNNEVRIKHIYNDILKQNKPYNTKGVIVQ

SEQ ID NO: 5111 - DNA, 1215 bp, Staphylococcus aureus
atgaataaatttttaaaatactttttgatccttctagcattggttctcattgttgttccaatagtcttcgctacgttactttttaaaacgtcccaagatgcattcgaatcttctcaagacagcaaaaatgctaatcgtcaatccaacttaagagataataaagtcaatcccgaagaacaacctatctctattcttttcttaggtatcgatgataacgatggaagaagaaaaaaaggacaggatgctgaacactctagatcagacgctatgattttaactacttttaatcaatcaaaacatcaaattagaatgcttagtattccacgtgatactatcagctacattcctaaagttggctattacgataagattacccatgcacatgcatatggtggtccaattgccgcaatggattcggtagaagctaccatgaatgtacctgttgattattatgtgagagtcaatatgaaagcatttgtcgaggctgtaaatgagcttggtggcatatactatgatgtgccatacgacttaaatgaacctaacacagatgatactggtaagattaaaattaaaaaagggtaccaaaaattaaatggtgatgaggctttagcagttgctagaactagacatcatgattcagacttaaaacgtggacaacgtcaaatggaattaattaagattttattccaaaaagcacaggaagttgattctattgataaacttgataacgtgattcaaattgtaggtaaaaatgcaaagcataatttaactaactctgaaattaaagctttagcaaaaatgtacttaacaaatgatgttgaaattaaaactgcgcaattaaaaggtaaagatgatatgttaaatggtatttactattatcatccaagtgttgaaagcattcaaaaatatgcaaacttacttcgtaaagacttagaattatcacctattaatgataaaaatgatttcttagatcaacgtgtcattaatcattatggttcattaataccattaacgcctttagataatagtttattgagaaaagaacaaaatgatacgacagataaagataagacatctaacgagaacagtgattcaactaataacagtgattccagcaatcaacaacaacctgctacagatcaaaactcaaatcaaaatcaaggtggcacacaacaagcgccacaagcttcaaataaccaaaatggtgttgtaaat

SEQ ID NO: 5112 - protein, 405 aa, Staphylococcus aureus
  MISC_FEATURE (1)..(405): conserved hypothetical
MNKFLKYFLILLALVLIVVPIVFATLLFKTSQDAFESSQDSKNANRQSNLRDNKVNPEEQPISILFLGIDDNDGRRKKGQDAEHSRSDAMILTTFNQSKHQIRMLSIPRDTISYIPKVGYYDKITHAHAYGGPIAAMDSVEATMNVPVDYYVRVNMKAFVEAVNELGGIYYDVPYDLNEPNTDDTGKIKIKKGYQKLNGDEALAVARTRHHDSDLKRGQRQMELIKILFQKAQEVDSIDKLDNVIQIVGKNAKHNLTNSEIKALAKMYLTNDVEIKTAQLKGKDDMLNGIYYYHPSVESIQKYANLLRKDLELSPINDKNDFLDQRVINHYGSLIPLTPLDNSLLRKEQNDTTDKDKTSNENSDSTNNSDSSNQQQPATDQNSNQNQGGTQQAPQASNNQNGVVN

SEQ ID NO: 5113 - DNA, 468 bp, Staphylococcus aureus
atgagtagaaaaacatacgaaaagattgcaaatataaatggcatgtttaatatgttagaacaacaaatcattcatagccaagatatggctcattttagaagtgaatttttttacgtcaatcatgagcatcgagaaaactatgaagcactcctaatttattacaaaaatagtatcgacaatcctattgtagatggtgcatgttatattttagccctacctgaaattttcaatagtgttgatgttttcgaatcagagttaccattttcatgggtatatgatgaaaatggcattaccgaaacaatgaaatcacttagcattccattacaatatttagttgcagcagctttagaagtaactgatgtgaatatatttaagccttcaggatttacaatgggaatgaataattggaatattgctcaaatgcgaatcttttggcaatatacagcaattattagaaaagaagcacta

SEQ ID NO: 5114 - protein, 156 aa, Staphylococcus aureus
  MISC_FEATURE (1)..(156): conserved hypothetical
MSRKTYEKIANINGMFNMLEQQIIHSQDMAHFRSEFFYVNHEHRENYEALLIYYKNSIDNPIVDGACYILALPEIFNSVDVFESELPFSWVYDENGITETMKSLSIPLQYLVAAALEVTDVNIFKPSGFTMGMNNWNIAQMRIFWQYTAIIRKEAL

SEQ ID NO: 5115 - DNA, 447 bp, Staphylococcus aureus
atgtggaggaattttatgttttcaaaagtaaacaatcaaaagatgttagaagattgcttctatataagaaagaaagtgtttgtagaagaacaaggcgtccctgaggaaagtgaaattgatgaatatgaatctgaatctattcacctcattggatatgataatggacagccagttgccactgctcgaatacgccctattaatgaaacaactgtcaaaatagaacgagtagctgtgatgaaatcacatcgtggacaaggaatgggtagaatgcttatgcaagctgtagaatcattagctaaagatgaaggtttttacgtagctactatgaatgcccaatgtcatgctatcccattttatgaaagtttaaactttaaaatgagaggtaatatatttcttgaggaaggcatcgagcatattgaaatgacaaaaaagttaacctcgcttaat

SEQ ID NO: 5116 - protein, 149 aa, Staphylococcus aureus
  MISC_FEATURE (1)..(149): conserved hypothetical
MWRNFMFSKVNNQKMLEDCFYIRKKVFVEEQGVPEESEIDEYESESIHLIGYDNGQPVATARIRPINETTVKIERVAVMKSHRGQGMGRMLMQAVESLAKDEGFYVATMNAQCHAIPFYESLNFKMRGNIFLEEGIEHIEMTKKLTSLN

SEQ ID NO: 5117 - DNA, 3789 bp, Staphylococcus aureus
atgttaggagtaataaatagaatggcgaaaaaattcaattacaaactaccatcaatggttgcattaacgcttgtaggttcagcagtcactgcacatcaagttcaagcagctgagacgacacaagatcaaactactaataaaaacgttttagatagtaataaagttaaagcaactactgaacaagcaaaagctgaggtaaaaaatccaacgcaaaacatttctggcactcaagtatatcaagaccctgctattgtccaaccaaaaacagcaaataacaaaacaggcaatgctcaagtaagtcaaaaagttgatactgcacaagtaaatggtgacactcgtgctaatcaatcagcgactacaaataatacgcagcctgttgcaaagtcaacaagcactacagcacctaaaactaacactaatgttacaaatgctggttatagtttagttgatgatgaagatgataattcagaaaatcaaattaatccagaattaattaaatcagctgctaaacctgcagctcttgaaacgcaatataaaaccgcagcacctaaagctgcaactacatcagcacctaaagctaaaactgaagcgacacctaaagtaactacttttagcgcttcagcacaaccaagatcagttgctgcaacaccaaaaacgagtttgccaaaatataaaccacaagtaaactcttcaattaacgattacatttgtaaaaataacttaaaagcacctaaaattgaagaagattatacatcttacttccctaaatacgcataccgtaacggcgtaggtcgtcctgaaggtatcgtagttcatgatacagctaatgatcgttcgacgataaatggtgaaattagttatatgaaaaataactatcaaaacgcattcgtacatgcatttgttgatggggatcgtataatcgaaacagcaccaacggattacttatcttggggtgtcggtgcagtcggtaaccctagattcatcaatgttgaaatcgtacacacacacgactatgcttcatttgcacgttcaatgaataactatgctgactatgcagctacacaattacaatattatggtttaaaaccagacagtgctgagtatgatggaaatggtacagtatggactcactacgctgtaagtaaatatttaggtggtactgaccatgccgatccacatggatatttaagaagtcataattatagttatgatcaattatatgacttaattaatgaaaaatatttaataaaaatgggtaaagtggcgccatggggtacgcaatctacaactacccctactacaccatcaaaaccaacaacaccgtcgaaaccatcaactggtaaattaacagttgctgcaaacaatggtgtcgcacaaatcaaaccaacaaatagtggtttatatactactgtatacgacaaaactggtaaagcaactaatgaagttcaaaaaacatttgctgtatctaaaacagctacattaggtaatcaaaaattctatcttgttcaagattacaattctggtaataaatttggttgggttaaagaaggcgatgtggtttacaacacagctaaatcacctgtaaatgtaaatcaatcatattcaatcaaacctggtacgaaactttatacagtaccttggggtacatctaaacaagttgctggtagtgtgtctggctctggaaaccaaacatttaaggcttcaaagcaacaacaaattgataaatcaatttatttatatggctctgtgaatggtaaatctggttgggtaagtaaagcatatttagttgatactgctaaacctacgcctacaccaacacctaagccatcaacacctacaacaaataataaattaacagtttcatcattaaacggtgttgctcaaattaatgctaaaaacaatggcttattcactacagtttatgacaaaactggtaagccaacgaaagaagttcaaaaaacatttgctgtaacaaaagaagcaagtttaggtggaaacaaattctacttagttaaagattacaatagtccaactttaattggttgggttaaacaaggtgacgttatttataacaatgcaaaatcacctgtaaatgtaatgcaaacatatacagtaaaaccaggcactaaattatattcagtaccttggggcacttataaacaagaagctggtgcagtttctggtacaggtaaccaaacttttaaagcgactaagcaacaacaaattgataaatctatctatttatttggaactgtaaatggtaaatctggttgggtaagtaaagcatatttagctgtacctgctgcacctaaaaaagcagtagcacaaccaaaaacagctgtaaaagcttatactgttactaaaccacaaacgactcaaacagttagcaagattgctcaagttaaaccaaacaacactggtattcgtgcttctgtttatgaaaaaacagcgaaaaacggtgcgaaatatgcagaccgtacgttctatgtaacaaaagagcgtgctcatggtaatgaaacgtatgtattattaaacaatacaagccataacatcccattaggttggttcaatgtaaaagacttaaatgttcaaaacttaggcaaagaagttaaaacgactcaaaaatatactgttaataaatcaaataacggcttatcaatggttccttggggtactaaaaaccaagtcattttaacaggcaataacattgctcaaggtacatttaatgcaacgaaacaagtatctgtaggcaaagatgtttatttatacggtactattaataaccgcactggttgggtaaatgcaaaagatttaactgcaccaactgctgtgaaaccaactacatcagctgccaaagattataactacacttatgtaattaaaaatggtaatggttattactatgtaacaccaaattctgatacagctaaatactcattaaaagcatttaatgaacaaccattcgcagttgttaaagaacaagtcattaatggacaaacttggtactatggtaaattatctaacggtaaattagcatggattaaatcaactgatttagctaaagaattaattaagtataatcaaacaggtatgacattaaaccaagttgctcaaatacaagctggtttacaatataaaccacaagtacaacgtgtaccaggtaagtggacagatgctaaatttaatgatgttaagcatgcaatggatacgaagcgtttagctcaagatccagcattaaaatatcaattcttacgcttagaccaaccacaaaatatttctattgataaaattaatcaattcttaaaaggtaaaggtgtattagaaaaccaaggtgctgcatttaacaaagctgctcaaatgtatggcattaatgaagtttatcttatctcacatgccctattagaaacaggtaacggtacttctcaattagcgaaaggtgcagatgtagtgaacaacaaagttgtaactaactcaaacacgaaataccataacgtatttggtattgctgcatatgataacgatcctttacgtgaaggtattaaatatgctaaacaagctggttgggacacagtatcaaaagcaatcgttggtggtgctaaattcatcggcaactcatatgtaaaagctggtcaaaatacactttacaaaatgagatggaatcctgcacatccaggaacacaccaatatgctacagatgtagattgggctaacatcaatgctaaaatcatcaaaggctactatgataaaattggcgaagtcggcaaatacttcgacatcccacaatataaa

SEQ ID NO: 5118 - protein, 1263 aa, Staphylococcus aureus
  MISC_FEATURE (1)..(1263): autolysin [Staphylococcus
MLGVINRMAKKFNYKLPSMVALTLVGSAVTAHQVQAAETTQDQTTNKNVLDSNKVKATTEQAKAEVKNPTQNISGTQVYQDPAIVQPKTANNKTGNAQVSQKVDTAQVNGDTRANQSATTNNTQPVAKSTSTTAPKTNTNVTNAGYSLVDDEDDNSENQINPELIKSAAKPAALETQYKTAAPKAATTSAPKAKTEATPKVTTFSASAQPRSVAATPKTSLPKYKPQVNSSINDYICKNNLKAPKIEEDYTSYFPKYAYRNGVGRPEGIVVHDTANDRSTINGEISYMKNNYQNAFVHAFVDGDRIIETAPTDYLSWGVGAVGNPRFINVEIVHTHDYASFARSMNNYADYAATQLQYYGLKPDSAEYDGNGTVWTHYAVSKYLGGTDHADPHGYLRSHNYSYDQLYDLINEKYLIKMGKVAPWGTQSTTTPTTPSKPTTPSKPSTGKLTVAANNGVAQIKPTNSGLYTTVYDKTGKATNEVQKTFAVSKTATLGNQKFYLVQDYNSGNKFGWVKEGDVVYNTAKSPVNVNQSYSIKPGTKLYTVPWGTSKQVAGSVSGSGNQTFKASKQQQIDKSIYLYGSVNGKSGWVSKAYLVDTAKPTPTPTPKPSTPTTNNKLTVSSLNGVAQINAKNNGLFTTVYDKTGKPTKEVQKTFAVTKEASLGGNKFYLVKDYNSPTLIGWVKQGDVIYNNAKSPVNVMQTYTVKPGTKLYSVPWGTYKQEAGAVSGTGNQTFKATKQQQIDKSIYLFGTVNGKSGWVSKAYLAVPAAPKKAVAQPKTAVKAYTVTKPQTTQTVSKIAQVKPNNTGIRASVYEKTAKNGAKYADRTFYVTKERAHGNETYVLLNNTSHNIPLGWFNVKDLNVQNLGKEVKTTQKYTVNKSNNGLSMVPWGTKNQVILTGNNIAQGTFNATKQVSVGKDVYLYGTINNRTGWVNAKDLTAPTAVKPTTSAAKDYNYTYVIKNGNGYYYVTPNSDTAKYSLKAFNEQPFAVVKEQVINGQTWYYGKLSNGKLAWIKSTDLAKELIKYNQTGMTLNQVAQIQAGLQYKPQVQRVPGKWTDAKFNDVKHAMDTKRLAQDPALKYQFLRLDQPQNISIDKINQFLKGKGVLENQGAAFNKAAQMYGINEVYLISHALLETGNGTSQLAKGADVVNNKVVTNSNTKYHNVFGIAAYDNDPLREGIKYAKQAGWDTVSKAIVGGAKFIGNSYVKAGQNTLYKMRWNPAHPGTHQYATDVDWANINAKIIKGYYDKIGEVGKYFDIPQYK

SEQ ID NO: 5119 - DNA, 108 bp, Staphylococcus aureus
gtgtcgttgtgcacacaacaaaaattgaatcatgaattacaagcaaaagtagcggtgattgttaaaattgatggtaaacaatcaccgctatttttgcttgtgtatgta

SEQ ID NO: 5120 - protein, 36 aa, Staphylococcus aureus
VSLCTQQKLNHELQAKVAVIVKIDGKQSPLFLLVYV

SEQ ID NO: 5121 - DNA, 417 bp, Staphylococcus aureus
atgtataaacaacttgaaaaacttattacactgactaacaatgacttaaacttagtgaatagaagatttggacaacgcacggatatcacatctgaacagctagaacttctccgtattttatttaattacgatcgcttatcacagtatgatttgacgatgaagattagcagggaacaatctatagtttcaaggtggattaagaaattagttttgaaagggtacatcacaagtcaacaatctagcgaagatttaagatgtaaagaattaattttgactgatcaagcacgtacattaatttcacaaataaataatgcacgttgcgaattgattgaagcaagatgtcaatgtttatcggaagtcgaattagacaatttaaatcaattacttgataagttaaatcaacgacgcatatcgttg

SEQ ID NO: 5122 - protein, 139 aa, Staphylococcus aureus
  MISC_FEATURE (1)..(139): hypothetical protein
MYKQLEKLITLTNNDLNLVNRRFGQRTDITSEQLELLRILFNYDRLSQYDLTMKISREQSIVSRWIKKLVLKGYITSQQSSEDLRCKELILTDQARTLISQINNARCELIEARCQCLSEVELDNLNQLLDKLNQRRISL

SEQ ID NO: 5123 - DNA, 1008 bp, Staphylococcus aureus
atgacttcattaaaagagagagattatttttttgacaacgcaagagcaattttaatattattagtcgtatttggacatatgttacaaccctacactagtggcgataaatatttatcagcattatacctagttatttatagtttccatatgccaacatttttgtttatatctggttatttcgcgaaaaatattgataaaccatactatttagaaaaaatttcaaaacgtttgatagtaccttatatgatattttttgcattcttttcaatttattatttcttaacaggtaaaagtgacgaattacaacttgatccttttaacccagtatttgcgttatggtttttgatcacgctatttttctttcatgtcattttagtaatagttagaagatttaatccatataaagtgctatcagtttcaattattatatctattggagcaggtttttcagataacatcgatagctacttaagcatttcaaggacaatcgtatttttcccaatattttatctaggttacattttcaccaaaaaacatacggctatttttaaaaataaaaaactaataccagtatctatcattacctttattttgttttttatcgtttacgtgattcatcctatcaatgcagattggttattgggaagttcaccatatacttcacttgaaaatgaaggacagagtatattcagtccttttaaacgacttatattatatggaattatattaatcgcaatgactgcgtttctaaatttaatgtcaacaaagaaaaaattatatacttatattggtagtcgtacgctatacgtatatttattacatggtttaattattggcattgttagaggatttgaatggtacccattcgataatcctatatcattaatgacttatctttatttaataagtatatctgtaatcatcgtatatgtattatctacaaactttgtttgtaaatggacaaatccaataattaatttacaaagaccatcacagtttaaagattca

SEQ ID NO: 5124 - protein, 336 aa, Staphylococcus aureus
  MISC_FEATURE (1)..(336): conserved hypothetical
MTSLKERDYFFDNARAILILLVVFGHMLQPYTSGDKYLSALYLVIYSFHMPTFLFISGYFAKNIDKPYYLEKISKRLIVPYMIFFAFFSIYYFLTGKSDELQLDPFNPVFALWFLITLFFFHVILVIVRRFNPYKVLSVSIIISIGAGFSDNIDSYLSISRTIVFFPIFYLGYIFTKKHTAIFKNKKLIPVSIITFILFFIVYVIHPINADWLLGSSPYTSLENEGQSIFSPFKRLILYGIILIAMTAFLNLMSTKKKLYTYIGSRTLYVYLLHGLIIGIVRGFEWYPFDNPISLMTYLYLISISVIIVYVLSTNFVCKWTNPIINLQRPSQFKDS

SEQ ID NO: 5125 - DNA, 435 bp, Staphylococcus aureus
atgcgtcaaacatttatggcaaatgaatcaaacattgagcgcaaatggtatgttatcgatgctgaaggccaaacattaggtcgtttatcatcagaagtagcatctatcttacgcggtaaaaataaagtaacttacacaccacacgttgatactggtgattatgtaatcgttattaatgcatcaaaaatcgaatttactggtaacaaagaaactgacaaagtttactaccgtcactcaaatcacccaggtggtatcaaatcaatcactgctggtgaattaagaagaactaacccagaacgtttaattgaaaactcaattaaaggtatgttaccaagcactcgtttaggcgaaaaacaaggtaaaaaattatttgtatatggtggcgctgaacatccacacgctgcacaacaaccagaaaactacgaattacgtggt

SEQ ID NO: 5126 - protein, 145 aa, Staphylococcus aureus
  MISC_FEATURE (1)..(145): 50S ribosomal protein L13
MRQTFMANESNIERKWYVIDAEGQTLGRLSSEVASILRGKNKVTYTPHVDTGDYVIVINASKIEFTGNKETDKVYYRHSNHPGGIKSITAGELRRTNPERLIENSIKGMLPSTRLGEKQGKKLFVYGGAEHPHAAQQPENYELRG

SEQ ID NO: 5127 - DNA, 1161 bp, Staphylococcus aureus
gtgtcacaaatgaaactttctttaaattctaattctaaatatttaagagcaccaagtattcgccaattttcaaatcgtatgaataatttggatgattgtgttaatttaactattggccaaccagacttcccgatgcctgatgttgtgaaaaaggcatatattgatgctattaacaatgacaagacatcatactctcacaataaagggttattagaaactcgcgaagcaattagtcaatacttcaaaaatcgttatcatttttcctatgatcctgaagaaattattgtgacaaatggagcaagtgaagcaatagacacaacgttacgttctatcatagagcctggagatgaaattataataccgggaccaatttatgcaggctacataccactcatcgaagtactaggtggtaaaccaatttatattgatacaacagcaacacaatttaaaattacacctgatgcattagaaagtcatatttctccaaagacaaaagctgtcttgttaaattatccgactaatccaactggcgtagttttaaaaagaaatgaagttttaaatatcgtaaatgtattaaaaaaatatccgttatttattattagcgatgagatttatgctgaaaatacatttagtggtaaacatgtatccttcgctgaatttgaagacattcgtgatcaattaatattaattggtggtttaagtaaatcacactcagcaaccggaataagaattggttttctattaggacctcaatatttgattgataaattaacatttatgcacgcctataattgtatttttgccaatgttccagctcaaatagcatgtataacagcacttaacgaaggattagaagctcctaaatatatgaacgaagcttatgtagaacgaagaaattatttagtatctgaattaactaaattaggttttgagattaccgctcaacctgaaggcgcgttttatattttcccaagtattaaacatatcaccgatgacgatttcgaattttgtgtcgatttacttgaatcaacacatttagcaatcgttccaggctcatcctttacagaattcggtaaaggatttgtaaggatttcctatgcttatgaaatggatgttttaaaagaaggtatgaagagacttgctaaatatttaaatactaaa

SEQ ID NO: 5128 - protein, 387 aa, Staphylococcus aureus
  MISC_FEATURE (1)..(387): HisC homolog
VSQMKLSLNSNSKYLRAPSIRQFSNRMNNLDDCVNLTIGQPDFPMPDVVKKAYIDAINNDKTSYSHNKGLLETREAISQYFKNRYHFSYDPEEIIVTNGASEAIDTTLRSIIEPGDEIIIPGPIYAGYIPLIEVLGGKPIYIDTTATQFKITPDALESHISPKTKAVLLNYPTNPTGVVLKRNEVLNIVNVLKKYPLFIISDEIYAENTFSGKHVSFAEFEDIRDQLILIGGLSKSHSATGIRIGFLLGPQYLIDKLTFMHAYNCIFANVPAQIACITALNEGLEAPKYMNEAYVERRNYLVSELTKLGFEITAQPEGAFYIFPSIKHITDDDFEFCVDLLESTHLAIVPGSSFTEFGKGFVRISYAYEMDVLKEGMKRLAKYLNTK

SEQ ID NO: 5129 - DNA, 435 bp, Staphylococcus aureus
atggaagtgatgatattgaacttcaatcaattcgagaatcaaaacttttttaacggtaatccaagtgatacatttaaagatttaggtaaacaagtatttaattacttttcaacaccttcatttgtaacgaatatatatgaaacagacgaattatattacttagaagctgaactagcaggtgtaaataaagaagatattagtatcgatttcaataataatacgctcactattcaagctactagaagcgcaaaatacaaatctgaacaactcattttagatgagcgtaacttcgaatcattaatgcgtcaatttgattttgaagctgttgataagcaacatattactgctagttttgaaaatgggttattaaccattaccttgcctaaaatcaaaccaagcaatgaaactacttcatcaacatctattccaatttca

SEQ ID NO: 5130 - protein, 145 aa, Staphylococcus aureus
  MISC_FEATURE (1)..(145): hypothetical protein
MEVMILNFNQFENQNFFNGNPSDTFKDLGKQVFNYFSTPSFVTNIYETDELYYLEAELAGVNKEDISIDFNNNTLTIQATRSAKYKSEQLILDERNFESLMRQFDFEAVDKQHITASFENGLLTITLPKIKPSNETTSSTSIPIS

SEQ ID NO: 5131 - DNA, 1191 bp, Staphylococcus aureus
atgattttgatgaaggtgaaacgtatgtacaaaacaaaaggtggctttcaacttacattacaaacattaagtttagtggttgggtttatggcttggagtataattgcgccattaatgccctttattaaacaagatgtcaatgttactgaaggtcaaatatcaatcattttagcgataccagttattttgggatcggtgctccgtgtgccatttggttatttaacaaacattgttggcgctaaatgggtattctttactagttttatcgtattgttattcccgatatttttcttaagccaagcacaaacaccgggtatgttaatggcttcaggatttttccttggtgtaggtggtgcaattttctcagttggtgttacatcagttcctaaatatttccctaaagaaaaagtaggtctagcaaatggtatttatggtatgggaaatatcggtacagcagtttcttcatttttagcaccaccgatagcgggtattattggttggcaaacaacagttagaagttacttaattattatcgctttatttgcattaattatgttcatttttggtgacacacaagaacgtaaaattaaagtaccattaatggctcaaatgaaaacattatctaaaaactacaaattatattacttaagttattggtattttattacttttggtgcttttgtagcatttggtattttcttacctaactacttagtaaatcattttggaattgacaaagtagatgctggtattcgatcaggtgtattcattgcgctggcaacattcttaagaccaataggtggcattttaggtgataaatttaatgcagttaaagtattgatgattgattttgttgttatgattatcggtgccattattttaggtatttcagaccatatcgcattattcactgtaggctgtttaacaataagtatttgtgcaggtattggtaacggcttaatcttcaaattagtaccatcatacttcttaaatgaagcgggatccgcaaatggtatcgtatcaatgatgggtggtttaggaggattcttcccaccactagtaatcacgtacgtagctaatttaacaggatcaagtcatttagcatttattttcttagcggtatttggatgtattgcattatttaccatgcgtcatttataccaaaaagaatatggctcattgaaaaacggt

SEQ ID NO: 5132 - protein, 397 aa, Staphylococcus aureus
  MISC_FEATURE (1)..(397): nitrite extrusion protein
MILMKVKRMYKTKGGFQLTLQTLSLVVGFMAWSIIAPLMPFIKQDVNVTEGQISIILAIPVILGSVLRVPFGYLTNIVGAKWVFFTSFIVLLFPIFFLSQAQTPGMLMASGFFLGVGGAIFSVGVTSVPKYFPKEKVGLANGIYGMGNIGTAVSSFLAPPIAGIIGWQTTVRSYLIIIALFALIMFIFGDTQERKIKVPLMAQMKTLSKNYKLYYLSYWYFITFGAFVAFGIFLPNYLVNHFGIDKVDAGIRSGVFIALATFLRPIGGILGDKFNAVKVLMIDFVVMIIGAIILGISDHIALFTVGCLTISICAGIGNGLIFKLVPSYFLNEAGSANGIVSMMGGLGGFFPPLVITYVANLTGSSHLAFIFLAVFGCIALFTMRHLYQKEYGSLKNG

SEQ ID NO: 5133 - DNA, 636 bp, Staphylococcus aureus
atgtataaaatcaatattattagatcagattccgtctataataatatactcaaggcaccaataaacgaccgtgattcaattttcactaaagaaatattagtaccttttaaaaagaaatttgaggtacaacatatgcctatttataatgatgacaaacagacaatgagtgcgattcaatttttagatgcctttcaaatttctcccaaagatttacgcatgtctgaccaaatgtcaatacaatacctgaataatgatttctggagtaattgcgaaaaatatttaaaagttgctatagatcaattttcaaattatagtatctcatctcaagtttctaactatcatttcacagtattacttggagatcgccaaaaaccacttatgtatctaaataaaaatcgcggtggtgatggtggcataccaggttatattatgatttatttagtgccgagtacaagtacaattaattctatgaaaagcttaattgcacatgaagtaaatcataatatgcgctatcaatatattgattgggatggcggaagtttgattgaattgattattgcagaaggattagctgaaaactatgtagaatcattgtatggtaaagcgcatattggaccgtgggtaacaaatactaat

SEQ ID NO: 5134 - protein, 212 aa, Staphylococcus aureus
  MISC_FEATURE (1)..(212): conserved hypothetical
MYKINIIRSDSVYNNILKAPINDRDSIFTKEILVPFKKKFEVQHMPIYNDDKQTMSAIQFLDAFQISPKDLRMSDQMSIQYLNNDFWSNCEKYLKVAIDQFSNYSISSQVSNYHFTVLLGDRQKPLMYLNKNRGGDGGIPGYIMIYLVPSTSTINSMKSLIAHEVNHNMRYQYIDWDGGSLIELIIAEGLAENYVESLYGKAHIGPWVTNTN

SEQ ID NO: 5135 - DNA, 204 bp, Staphylococcus aureus
atgccttatctctatggtgatgatattaataaacttcaaggtaggcctatcgttggcttatctcatgctgccgggtatgcatgtggctatcacttggtaaaatactttttacaaaaaacaaacatacctattgaagttgctacaacacttccagcacaaaaaataataaatgaggtgactgaattttggcatacacatacactt

SEQ ID NO: 5136 - protein, 68 aa, Staphylococcus aureus
  MISC_FEATURE (1)..(68): conserved hypothetical
MPYLYGDDINKLQGRPIVGLSHAAGYACGYHLVKYFLQKTNIPIEVATTLPAQKIINEVTEFWHTHTL

SEQ ID NO: 5137 - DNA, 738 bp, Staphylococcus aureus
ttggcatacacatacactttaaaagatattattgaaattacaggtgtaactaaaagaactttacattattacgatgaaataggattattagttccagataaaaatgataaaaattatcgcgtttataaacagcaagacttagaaaaattacaaaagattttaatactcaagtcttttgattttgatatcgctaaaataaaacaatacatttcgtatgataatgaacaattgcgaaagttattatcagagcaaataagcaagttagataaaaagatttctgacttacaattaattagacgctctgtatgtgaatttattaaaggactctctctaatagataccagcattttaaacaagacactacagtcacaatatgataaagaagcatctataaaatatggtcatacgaaagcatatcaatcatttattagacgtaaagacagcttacaatcgcaggatatcagacataaattgacaactatcttcaataaatttaatcatatgtctttgagtcattatccaatccaagattgtagtgatctcgtatttgagtggaaggcatttatgaacactatcgctgattttgatgatgaaacattatgctgtattgctaaaacatatgaagatgatacgcgtttcaaagattactttaattcatatgataatcaaaatttagcatcatacatttcagaagctgttaattattttttgagcaatgtgaataagagcgacaatttt

SEQ ID NO: 5138 - protein, 246 aa, Staphylococcus aureus
  MISC_FEATURE (1)..(246): hypothetical protein
LAYTYTLKDIIEITGVTKRTLHYYDEIGLLVPDKNDKNYRVYKQQDLEKLQKILILKSFDFDIAKIKQYISYDNEQLRKLLSEQISKLDKKISDLQLIRRSVCEFIKGLSLIDTSILNKTLQSQYDKEASIKYGHTKAYQSFIRRKDSLQSQDIRHKLTTIFNKFNHMSLSHYPIQDCSDLVFEWKAFMNTIADFDDETLCCIAKTYEDDTRFKDYFNSYDNQNLASYISEAVNYFLSNVNKSDNF

SEQ ID NO: 5139 - DNA, 651 bp, Staphylococcus aureus
ttgaaaatagtcattgccgatgatcacgctgttgtccgtacggggttctctatgattttaaattatcaaaatgatatggaagttgttgcaacggctgcagatggcgtcgaagcttaccaaaaagtaatggaatataaacctgatgtgttactaatggatttaagtatgccaccaggtgagtcaggtcttatcgctacgagtaaaattgctgacagttttcctgaaactaaaatactaatattaacaatgtttgatgatgaggagtatttgttccatgtgttgcgtaatggtgcgaaaggttacatattgaaaaatgcacctgatgaacaattattgttagctattcgaactgtatataaaggtgaaacatatgtagatatgaaacttacaacatctttagtgaatgaatttgtatctaattcaaatcaggacactgcaaacacaacagatccttttaaaatcttatcaaaacgagaactagaaatattgccacttattgccaaaggttacgggaataaagaaattgcagagaaattatttgtatctgtgaaaacagtagaagcacataagacgcatattatgacaaagcttggcttaaagagtaaacctgagctagttgaatatgcattgaaaaagaaattattagagttt

SEQ ID NO: 5140 - protein, 217 aa, Staphylococcus aureus
  MISC_FEATURE (1)..(217): hypothetical protein
LKIVIADDHAVVRTGFSMILNYQNDMEVVATAADGVEAYQKVMEYKPDVLLMDLSMPPGESGLIATSKIADSFPETKILILTMFDDEEYLFHVLRNGAKGYILKNAPDEQLLLAIRTVYKGETYVDMKLTTSLVNEFVSNSNQDTANTTDPFKILSKRELEILPLIAKGYGNKEIAEKLFVSVKTVEAHKTHIMTKLGLKSKPELVEYALKKKLLEF

SEQ ID NO: 5141 - DNA, 1032 bp, Staphylococcus aureus
atgattaatgaggacagtatacagttagatactttattgaaaaaatattatgagcattcaatcgaaaagatagtttttgctgatgataacggtaaaattattgcaatgaatgatgctgctaaagatatattatctgaagaagataattacagtgctgtggcgaatgcgatttgtcacagatgtgaagggtatacaaatgcctatgatgtacaatcatgtaaagactgtttcttagaatcgatgcaagtacaagctacgaatttccaagtatttatgaagacgaaagatcaaaaagtgatgccatttacagcaacatatcagttgattgatcaagacaggggaattcatgcatttacgcttcaaaatgtttcatcacaaattgaacagcaagagaaattgcatcaacaacgtatgatgcgtaaaacaatctcagcccaagaaaatgaaagaaagcgaatttctagagagttacatgatagtgtgattcaagaaatgctcaatgtagatgttcaattgagattattaaaatatcaagaagatacaactaagcttttggaagacgcagaaaatattgaatatattgtcgctaaattaattgatgatatacgtaatatgtcggttgaattaagacccgcttctttggatgatctaggccttgaagcagcttttaaatcatattttaaacagtttgaagaaaattatggaataaaaatcatatatacatcaaatattaaaaatactcgctttgatagtgatattgaaacggttgtttatcgagtagtgcaagaagctattttaaatgcgttgaaatacgctgatgtaaatgaaataaatgtaggtatccgtcaaactgggcgccatttggtagcagaagtgatagatgcgggaaatggttttgatccaagttctaagcctaaaggttctggactcggtttatatggaatgaatgagcgagctgagttagtcagcggtagcgtcaatattgaaacgaaaattggtgagggtaccaatgttacattgaacattccaatt

SEQ ID NO: 5142 - protein, 344 aa, Staphylococcus aureus
  MISC_FEATURE (1)..(344): hypothetical protein
MINEDSIQLDTLLKKYYEHSIEKIVFADDNGKIIAMNDAAKDILSEEDNYSAVANAICHRCEGYTNAYDVQSCKDCFLESMQVQATNFQVFMKTKDQKVMPFTATYQLIDQDRGIHAFTLQNVSSQIEQQEKLHQQRMMRKTISAQENERKRISRELHDSVIQEMLNVDVQLRLLKYQEDTTKLLEDAENIEYIVAKLIDDIRNMSVELRPASLDDLGLEAAFKSYFKQFEENYGIKIIYTSNIKNTRFDSDIETVVYRVVQEAILNALKYADVNEINVGIRQTGRHLVAEVIDAGNGFDPSSKPKGSGLGLYGMNERAELVSGSVNIETKIGEGTNVTLNIPI

SEQ ID NO: 5143 - DNA, 450 bp, Staphylococcus aureus
ttgacaccagaagcaataattgaagatcgtagatttcaagagacattagataaaatacgcaaagaagagggttatgattttgcggcaatcgctttctatgaatctaacaaaccatcatctccaataaaatggcactatgtttcaggtaataaaaataatcgatttaaattgattattttaagaaaaggtcgtggattagctggaactgttatgaaaacaggaaagcgtatggtaatagccaatgttggtttagctttagggcctgaagaaaagattgactatccaattttattgagcgaatcattaacagcagttttagcagtgccgctttggtataagaatcaagtgtatggcgtactattatttggtcaaagagatggtcgtcctttaccaaaaatatttgataatgatgatattcaacgtaagtttggtattttcaatgatgataaa

SEQ ID NO: 5144 - protein, 150 aa, Staphylococcus aureus
  MISC_FEATURE (1)..(150): hypothetical protein
LTPEAIIEDRRFQETLDKIRKEEGYDFAAIAFYESNKPSSPIKWHYVSGNKNNRFKLIILRKGRGLAGTVMKTGKRMVIANVGLALGPEEKIDYPILLSESLTAVLAVPLWYKNQVYGVLLFGQRDGRPLPKIFDNDDIQRKFGIFNDDK

SEQ ID NO: 5145 - DNA, 801 bp, Staphylococcus aureus
atgcgtatattagtagaaattgcgtatcaaggaaataattttctaggttttcaaattcaacaaaatggtcgaacggtacagcaacaatttgaaaagctattacaacgcatgcataaaagacatgtgagaatccatccttcaagtaggactgatagaggtgtacatgcgatacagcaatactttcatttcgacacagagctgaatatacctatgtcacaatggcaatatgcaatgaaccgaacgttacctgatgatatttatgtcaacaatgtagttacagtcgatgacgattttcattgtcgttatgattgtgtaggtaaacgttatcgctacaaagtatatcaagcacaacaccgcgatccatttcaaagtggtttgaaaacatttattcctgaaacgttggatttaggtaaaatgaacagagcggcgcaacaattcataggtacacatgattttacgggattttgttcgcaaaaaactgaagtagaaagcaaagttagaacattataccaaagtgaaatcgtaaagacagatgatggctttgattatattgtcactggatctggatttttatataacatggtgcgtgtcttagttgcatttttaatagaagttggaaaagggcgacatgaagtatctgatgtaccaaaacttcttgaatcaaagaatcgtaagaatgtacctttcactgcaccggctgaaggattatatttagagaaaatttatttagatgaaaatgagttattaaaagactttggtaacgatatcaaaatacatcgtaaaaaatcattacaaaatgac

SEQ ID NO: 5146 - protein, 267 aa, Staphylococcus aureus
  MISC_FEATURE (1)..(267): tRNA pseudouridine synthase
MRILVEIAYQGNNFLGFQIQQNGRTVQQQFEKLLQRMHKRHVRIHPSSRTDRGVHAIQQYFHFDTELNIPMSQWQYAMNRTLPDDIYVNNVVTVDDDFHCRYDCVGKRYRYKVYQAQHRDPFQSGLKTFIPETLDLGKMNRAAQQFIGTHDFTGFCSQKTEVESKVRTLYQSEIVKTDDGFDYIVTGSGFLYNMVRVLVAFLIEVGKGRHEVSDVPKLLESKNRKNVPFTAPAEGLYLEKIYLDENELLKDFGNDIKIHRKKSLQND

SEQ ID NO: 5147 - DNA, 675 bp, Staphylococcus aureus
atgcttaatcagtttttatgggttatatttccgtatttatgtttagttgtctttgtcgcaggtcatattgcacgttatcgttatgataaattttcttggacagctaaatctagtgaattaatagaaagaaaaaggttgatgtggggaagtttattatttcacttaggtattattccagtgttttttggacacgtagttggattgttaataccgaaaccatggatggatgcagtgggtgtgtctgagcatttatatcatataggcgctgtttatattggtagcatctttggtataataactttgatagggatgtttttattaacagcgagacgtgttactacgaaaagtattcgaagattaagttcagcgtcggatatatttgtaaatttcttattattacttatcgtatttatgggatgttacgcaacattagtaacaaatatacaacatccagactttaactacagaacttcattatcaatttggtttagacaattatttatgttaaaaccagatgcgtcattgatgagtggtgtgccgattgcatttaaaatgcatatattgttaggtttcactattatggcttgttggccatttacacgtttggtgcatgtttggagtgtacctttgacatatataaatcgcagatatattatttaccgtaagaataaagtg

SEQ ID NO: 5148 - protein, 225 aa, Staphylococcus aureus
  MISC_FEATURE (1)..(225): nitrate reductase gamma
MLNQFLWVIFPYLCLVVFVAGHIARYRYDKFSWTAKSSELIERKRLMWGSLLFHLGIIPVFFGHVVGLLIPKPWMDAVGVSEHLYHIGAVYIGSIFGIITLIGMFLLTARRVTTKSIRRLSSASDIFVNFLLLLIVFMGCYATLVTNIQHPDFNYRTSLSIWFRQLFMLKPDASLMSGVPIAFKMHILLGFTIMACWPFTRLVHVWSVPLTYINRRYIIYRKNKV

SEQ ID NO: 5149 - DNA, 600 bp, Staphylococcus aureus
atgagaatttctatggagggattttccgtgattaatttcgataattttaaaaaatatcaagaaagttttggatatatggcacaacagttatgttttccagaaaaattaacttttcatccaaaaacttttgaagaaacaatttcgaaagatcatccagcatatgaagatttagtagcatttagaaatgtaatgatgacattttcattatcagaaatcaaagcgatttatacagatacatttgattttacgaaaaaagcaccattatatatgacgtataacaaatttgatacgcaaaaagaacgtgggcaaatgttagctaaattaaaggtattatatgaaatgtttggactagaaatggtagataatgaactttctgattatctaccgttgatgcttcaatttttgcaagtggcagaatggcgaaatgatccaagagctgaagagaatattcaattaatcattatgattattgaggatggaacatatgtgatggcgaatgcacttggtgaagataacaatccatatgcctatgtgattcaagcacttagaaaaacattgaaattatgtttgacatcaccaaaaggagtgaaacatcatgct

SEQ ID NO: 5150 - protein, 200 aa, Staphylococcus aureus
  MISC_FEATURE (1)..(200): hypothetical protein
MRISMEGFSVINFDNFKKYQESFGYMAQQLCFPEKLTFHPKTFEETISKDHPAYEDLVAFRNVMMTFSLSEIKAIYTDTFDFTKKAPLYMTYNKFDTQKERGQMLAKLKVLYEMFGLEMVDNELSDYLPLMLQFLQVAEWRNDPRAEENIQLIIMIIEDGTYVMANALGEDNNPYAYVIQALRKTLKLCLTSPKGVKHHA

SEQ ID NO: 5151 - DNA, 1557 bp, Staphylococcus aureus
ttgaagattaaagcgcaagttgcgatggtattaaatttagataaatgcataggatgccatacgtgtagtgtgacatgtaaaaacacttggacaaatcgtccaggtgctgagtacatgtggttcaacaacgtagaaacgaagccaggtgtagggtatccgaaacgttgggaagaccaagaacactacaaaggtggttgggtactaaatcgtaaagggaaacttgaattaaaatctggaagtagaatttcaaaaattgctttaggtaaaattttttataacccagatatgccattaattaaagattattatgagccatggaactataattatgaacatttaacaactgcgaaatcagggaagcattcgccagttgctagagcgtattcagaaattacgggggataacattgaaattgaatggggacctaactgggaagatgacttagcaggtggtcatgttacaggtccaaaagatcctaacatccaaaaaatagaagaagatattaaattccaatttgacgaaacttttatgatgtatttaccacgtttatgtgaacattgcttgaatccaagttgcgttgcatcgtgtccttcaggtgctatgtataaacgtgatgaagatggcattgtattagttgaccaagacgcatgtcgtggatggcgttactgtatgacaggttgtccatataagaaagtttacttcaattggaaaacgaacaaagctgaaaagtgtactttctgtttcccgagaatcgaggcgggtatgcctacggtatgctctgaaacttgtacaggacgtatgcgttacttaggtgttttattatatgatgcagatcgagttcatgaagcagcttcagcagtagacgagaaagatttatatgaaaaacaattagatatattcttaaacccatttgacgaagaagtcattgctcaagctgaaaaagatggtattggttacgattggattgaagctgcacaaaactctccaatttataagttagcaattgaatataaacttgcatttccgttacatcctgaatttagaacgatgccgatggtttggtattgcccaccacttagcccaattatgagctattttgaaggtaaaaatacaactcaaaatccagatgcgattttcccagccattgaagaaatgcgtttacctattgaatacttagctaatattttcactgcaggagatacagagccagtaaaaggagccctacaacgtatggcaatgatgagaagttatatgagatctcaagttactcaacagccatttgacacgtctcgattagagcgattaggtataaccgagcgccaaactaaagacatgtatcgtttattaggactagccaaatatgaagatcgatttgttattccaacatcacacaaagaaacctatttagatacgtatcacgcacaaggtagtacaggatacaattacggcggcgagcattttggagataactgtgaaggctgtggcgttgcagtaggttcagggaaaactggtcaagaaatttataatgagaatttctatggagggattttccgtgat

SEQ ID NO: 5152 - protein, 519 aa, Staphylococcus aureus
  MISC_FEATURE (1)..(519): nitrate reductase beta
LKIKAQVAMVLNLDKCIGCHTCSVTCKNTWTNRPGAEYMWFNNVETKPGVGYPKRWEDQEHYKGGWVLNRKGKLELKSGSRISKIALGKIFYNPDMPLIKDYYEPWNYNYEHLTTAKSGKHSPVARAYSEITGDNIEIEWGPNWEDDLAGGHVTGPKDPNIQKIEEDIKFQFDETFMMYLPRLCEHCLNPSCVASCPSGAMYKRDEDGIVLVDQDACRGWRYCMTGCPYKKVYFNWKTNKAEKCTFCFPRIEAGMPTVCSETCTGRMRYLGVLLYDADRVHEAASAVDEKDLYEKQLDIFLNPFDEEVIAQAEKDGIGYDWIEAAQNSPIYKLAIEYKLAFPLHPEFRTMPMVWYCPPLSPIMSYFEGKNTTQNPDAIFPAIEEMRLPIEYLANIFTAGDTEPVKGALQRMAMMRSYMRSQVTQQPFDTSRLERLGITERQTKDMYRLLGLAKYEDRFVIPTSHKETYLDTYHAQGSTGYNYGGEHFGDNCEGCGVAVGSGKTGQEIYNENFYGGIFRD

SEQ ID NO: 5153 - DNA, 3687 bp, Staphylococcus aureus
atgggaaaatttggattgaatttctttaagccaacagaaaaatttaatgggaattggtcgatcctagaaagtaaaagtagagaatgggaaaaaatgtacagagaacgttggagccacgataaagaagtaagaacaacacatggtgttaactgtacaggctcatgttcttggaaagtatttgtgaaaaatggtgtgattacctgggaaaatcaacaaactgactatccaagttgtggtccggatatgcctgaatatgaaccgagaggatgtccacgaggtgcgtcattctcttggtatgaatacagtccgcttcgaatcaaatatccatatattcgtggaaaactctgggatttatggactgaagcattagaagaaaacaatggtaatcgcgttgctgcatgggcgtctattgttgaaaatgaagacaaagccaaacaatataagcaagcccgaggtatgggagggcacgtgcgttcaaattggaaagacgttacagagataatcgcagcacaattactgtatacaataaaaaaatatggtccagatcgaatcgcaggatttacacctattccagcgatgtcaatgattagttatgcagcaggtgctcgattcatcaatttgcttggtggtgaaatgcttagtttttatgactggtatgcagatttaccacctgcctctccacaaatttggggagagcaaacagatgtgcctgaatcaagtgactggtataacgcatcatacattattatgtggggctctaatgtacctttaacacgtactccggatgcacattttatgactgaagtccgctataaaggtacaaaagtcatttcagtagcaccagattacgcagaaaatgtgaaatttgcagataactggctagcaccgaatcctggttcagatgctgcaattgcacaagcaatgacgcatgttattttacaagaacattatgttaatcaacctaatgaacgctttataaattacgctaaacaatatacagatatgccgtttcttatcatgctggatgaagatgaaaatggatataaagcgggtcgatttttaagagcgagtgacttaggtcaaacaacagagcaaggcgaatggaagccagttattcatgatgcaatcagcgatagtttagtagtacctaatggcacaatgggtcaacgttgggaagaaggtaagaagtggaacttaaaactagaaacagaagatggttctaaaattaaccctacattatcaatgacagaaggtggatacgaattagaaacaattcaattcccatactttgatagtgatggagatgggatattcaatcgtccaattccaactcgacaagtcactttagcaaatggtgacaaagtccgtattgctacaatttttgacttaatggcaagtcaatatggcgtgcgtcgttttgatcataaattagaatcaaaaggatacgacgatgcagaatcaaaatatacacctgcttggcaagaagccatttcaggcgtaaaacaaagtgttgtcattcaagtagcgaaagaatttgcgcaaaacgctatcgatactgaagggcgttcaatgattatcatgggtgcgggtattaaccattggtttaactcagatacgatttatcgttcaatcttaaacttagttatgttatgtggctgtcaaggtgtgaatggtggcggttgggctcactatgtgggacaagaaaaatgtcgtccgattgaaggatggagtactgtcgcatttgcgaaagactggcaaggaccaccacgtttgcaaaacggaacaagttggttctattttgcaacagaccaatggaaatatgaagagtcaaatgtagatcgtttaaaatctccattagctaaaacagaggagttaaagcatcaacatccagctgattataatgttttagcagctagacttggttggttaccatcatatccacaatttaataaaaatagtttgttgtttgcagaagaagctaaagatgaaggtatagattcaaatgaagcgattttgcaacgtgcaattgatgaagtgaaatcaaaacaaacacaatttgcaatagaagatcctgatttgaaaaagaatcatccaaaatcattatttatatggcgttcaaacttaatttcaagttctgcaaaaggtcaagaatactttatgaagcatttacttggcacaaaatcagggttattagctacaccaaatgaagatgaaaagccagaagaaattacgtggcgtgaagaaacaacaggtaagttagatttagtggtctctttagacttcagaatgacggcaacaccgttatattctgacattgttttgccggcagcgacttggtatgaaaaacatgatttatcatcaacggatatgcatccatatgtacatcctttcaatcctgccattgatccgttatgggaatcgcgttcagactgggatatttataaaacgttggcaaaagcattttcagaaatggcaaaagactatttacctggaacgtttaaagatgttgtgacaactccacttagtcatgatacaaagcaagaaatttcaacaccatacggcgtagtgaaagattggtcgaagggtgaaattgaagcggtacctggacgtacaatgcctaactttgcaattgtagaacgcgactacactaaaatttacgacaaatatgtcacgcttggtcctgtacttgaaaaagggaaagttggagcacatggtgtaagtttcggtgtcagtgaacaatatgaagaattaaaaagtatgttaggtacgtggagtgatacaaatgatgattctgtgagagcgaatcgtccacgtattgatacagcacgtaatgtagctgatgcaatactaagtatttcatctgctacgaatggtaaattatcacaaaaatcatatgaagatctcgaagaacaaactggaatgccgttaaaagatatttctagcgaacgcgctgctgagaaaatttcgtttttaaatataacttcacaaccacgagaagtaataccgacagcagtattcccaggttcaaataaacaaggtcgacgatattcaccatttacaacgaatatagaacgtctagtaccttttagaacattaacaggacgtcaaagttattatgtggatcacgaagttttccaacaatttggggagagcttaccagtatataaaccgacattgccgccaatggtatttgggaatagagataagaaaattaaaggtggtacagatgctttggtactgcgttatttaacgcctcatggaaaatggaatatacactcaatgtatcaagataataagcatatgttgacactatttagaggtggtccaacggtttggatatcaaatgaagatgctgaaaaacacgatatccaagataatgattggctagaagtgtataaccgtaatggtgttgtaacggcaagagcagttatttcgcatcgtatgcctaaaggtacaatgtttatgtatcatgcacaagataaacatattcaaacgcctgggtcagaaattacagatacacgtggtggttcacacaacgcgccgactagaatccatttgaaaccaacacaactagtcggaggatacgcacaaattagttatcactttaattattatggaccaattgggaaccaaagggatttatatgtagcagttagaaagatgaaggaggttaattggcttgaagat

SEQ ID NO: 5154 - protein, 1229 aa, Staphylococcus aureus
  MISC_FEATURE (1)..(1229): respiratory nitrate reductase
MGKFGLNFFKPTEKFNGNWSILESKSREWEKMYRERWSHDKEVRTTHGVNCTGSCSWKVFVKNGVITWENQQTDYPSCGPDMPEYEPRGCPRGASFSWYEYSPLRIKYPYIRGKLWDLWTEALEENNGNRVAAWASIVENEDKAKQYKQARGMGGHVRSNWKDVTEIIAAQLLYTIKKYGPDRIAGFTPIPAMSMISYAAGARFINLLGGEMLSFYDWYADLPPASPQIWGEQTDVPESSDWYNASYIIMWGSNVPLTRTPDAHFMTEVRYKGTKVISVAPDYAENVKFADNWLAPNPGSDAAIAQAMTHVILQEHYVNQPNERFINYAKQYTDMPFLIMLDEDENGYKAGRFLRASDLGQTTEQGEWKPVIHDAISDSLVVPNGTMGQRWEEGKKWNLKLETEDGSKINPTLSMTEGGYELETIQFPYFDSDGDGIFNRPIPTRQVTLANGDKVRIATIFDLMASQYGVRRFDHKLESKGYDDAESKYTPAWQEAISGVKQSVVIQVAKEFAQNAIDTEGRSMIIMGAGINHWFNSDTIYRSILNLVMLCGCQGVNGGGWAHYVGQEKCRPIEGWSTVAFAKDWQGPPRLQNGTSWFYFATDQWKYEESNVDRLKSPLAKTEELKHQHPADYNVLAARLGWLPSYPQFNKNSLLFAEEAKDEGIDSNEAILQRAIDEVKSKQTQFAIEDPDLKKNHPKSLFIWRSNLISSSAKGQEYFMKHLLGTKSGLLATPNEDEKPEEITWREETTGKLDLVVSLDFRMTATPLYSDIVLPAATWYEKHDLSSTDMHPYVHPFNPAIDPLWESRSDWDIYKTLAKAFSEMAKDYLPGTFKDVVTTPLSHDTKQEISTPYGVVKDWSKGEIEAVPGRTMPNFAIVERDYTKIYDKYVTLGPVLEKGKVGAHGVSFGVSEQYEELKSMLGTWSDTNDDSVRANRPRIDTARNVADAILSISSATNGKLSQKSYEDLEEQTGMPLKDISSERAAEKISFLNITSQPREVIPTAVFPGSNKQGRRYSPFTTNIERLVPFRTLTGRQSYYVDHEVFQQFGESLPVYKPTLPPMVFGNRDKKIKGGTDALVLRYLTPHGKWNIHSMYQDNKHMLTLFRGGPTVWISNEDAEKHDIQDNDWLEVYNRNGVVTARAVISHRMPKGTMFMYHAQDKHIQTPGSEITDTRGGSHNAPTRIHLKPTQLVGGYAQISYHFNYYGPIGNQRDLYVAVRKMKEVNWLED

SEQ ID NO: 5155 - DNA, 975 bp, Staphylococcus aureus
atgtctgtagaggaatatggcaaggtttacttgataggtgcgggtccaggtaatccgaattatttgacgaaaaaggctgagcgtttaatacgtgaagcggatgtcattctatatgatcgattagtgaatccgttaattttacaatatgcgaatttgactactgaaattatcgatgttggtaaaaagccgtatgcaaaacatattcagcaagaaaaaataaatgactgtatcgtggaagcagcgcgtcgatataacaaggttgttagacttaaaggtggcgatccagcgatatttggtcgtgtgcaagaagaagtcgacatactaaatgaacatcatattgcgtttgaaattgtaccaggggtgacatcagcgagcgcagcagttgctactatgcagacaggtttgacaatgcgtacagttgctaaaagtgtgacattttctacaggtcactttaaagattcagaagaaaatgaagtggatgtcaattccttagtgaatggtggcacgttagcaatttatatgggggtaaaacgtttagggaaaattatcacacagatacaacaatacacagatattgattacccgatagcgattgtctttcaagcatcgtgttttaacgagtttgttgttaaggggcgtttaagtaatattatttcaaaattgcaacactattcaattgaggcgaaaccaggtatatgtattataggggaagttgttgattatactgaaaacactcctaaatcatatgatcctatgaagcaattttatgtagtaagtggttctaaacatgacgcccttatgctctgtgaacatttatatgacgaaggttatggctgtttgctaaacccaaatgatacatcgaatggcacatatcattcgtcgcaatatgattactatgatgcatttattaagcagcaagaaaatgtaacatatatttcaaccgatcgtgcagatgctaatacagtgttatgtcac

SEQ ID NO: 5156 - protein, 325 aa, Staphylococcus aureus
  MISC_FEATURE (1)..(325): uroporphyrin-III C-methyl
MSVEEYGKVYLIGAGPGNPNYLTKKAERLIREADVILYDRLVNPLILQYANLTTEIIDVGKKPYAKHIQQEKINDCIVEAARRYNKVVRLKGGDPAIFGRVQEEVDILNEHHIAFEIVPGVTSASAAVATMQTGLTMRTVAKSVTFSTGHFKDSEENEVDVNSLVNGGTLAIYMGVKRLGKIITQIQQYTDIDYPIAIVFQASCFNEFVVKGRLSNIISKLQHYSIEAKPGICIIGEVVDYTENTPKSYDPMKQFYVVSGSKHDALMLCEHLYDEGYGCLLNPNDTSNGTYHSSQYDYYDAFIKQQENVTYISTDRADANTVLCH

SEQ ID NO: 5157 - DNA, 312 bp, Staphylococcus aureus
atggaaacaaaagaaaaaattaaagtgacaactatagatgaattaacacccctaattggaaaaaaggttattgtcaaaggcaaagaggtagggttgtttttaacagaaagtggcaaaattcatgcgattcacaatatctgtccacacaaacaaggaccattgtctgaagggacagtgagtggggaatatgtattttgcccgctccacgatcaaaaaattgatttaaatacaggtattgttcaagaacctgatgaaggttgtgtagatgtttatgaggtagaagttacagacgggaacgtatatatatgtctg

SEQ ID NO: 5158 - protein, 104 aa, Staphylococcus aureus
  MISC_FEATURE (1)..(104): assimilatory nitrite
METKEKIKVTTIDELTPLIGKKVIVKGKEVGLFLTESGKIHAIHNICPHKQGPLSEGTVSGEYVFCPLHDQKIDLNTGIVQEPDEGCVDVYEVEVTDGNVYICL

SEQ ID NO: 5159 - DNA, 2403 bp, Staphylococcus aureus
atggcaaagcaaaaactagtaatgattggtaacggtatggcgggcattcgaacaatcgaagaaatattagagcgcgccaacgatttatatgatattacggtaataggtaaagaaccttatccaaactataaccgcatcatgctttcaaatattttacaaaataaaatgacagttgaagaaacaattatgaatccatatgagtggtatgaggaacatggtatcgagttaattacaaatgatcctgtaattgaagtagatagagcaaatcaatcagttactactgcaaatggtattgaagtatcatacgataaattgatttttgcgacaggttctaaagcattcgtcattccagttccaggttcgacattaccgagtgtaattggttggagaacgattgatgatactgaacaaatgatgaacattgctaagactaaaaagaaagcaattgtaattggtggaggattactaggtttagagtgtgcacgtggtttattagatcaaggtatggaagtaacggtgttacatttagctgaatggttgatggaaatgcaactagaccgtaaagctggaaatatgcttaaagcagatctagaaaagcaaggtatgaagtttgaaatgcaagccaacacaactgaaatcttaggagaagatgatgttgagggtgttaaattggctgatggacgcgagattccggcagacttagttgttatggcagtaggtatacgaccatacacagaagtagccaaagaatcaggtctagatgttaatcgtggtattgttgtcaatgatgtgatgcaaacaagtgatagcaatgtatatgcagttggtgaatgtgcagaacataacggcaaagtttatggactcgttgcaccactatatgaacaaggtaaagtattagctgatcatttaacaaataaagaaacgaacggatacaagggatcaacaacatttacgtcattaaaagtttctgggtgtgacttgtatagtgctggtcaaattgtagaaaatgcagaaattaaaggtattgaaatatttaatagtgttgataataactataaaaaaatctttttaaaagacggtaatgtagttggtgcagtactatatggtgatatcgatgatggttcacgcttttataacatgatgaaaaaaggtgaatccactgaagattacacacttgtatcattgcttactaaaggtggagaagaggcatcgctatcaattgctgatatggctgatgatgaaacaatttgtggttgtaatggtgttgataaaggtactatagtaaatgcgattacggaaaatggctttacaacagttgaagaagtaacggctaaaacaaaagcggggaattcatgtggtaaatgtaaaccgcaaattgctcaaatattgcagcacaccttaggagatgactttgttgccgcaaaacctgctggtatatgtggttgtactgatttgacacgcgatcaaatagtaacgcaaataagagcgaaaggtttaaaaacatctaaagaagttcgacatgttttaaactttaaaaataaaggtggatgtccaaaatgtcgaccagcaatcaactattatttaaacatggtttatccacatgatcatgaagatgaaagagaatcaagatttgctaacgaacgttaccatgcgaatattcaaaatgatggtacattttctgttatacctcaaatgcgtgggggtgttacagatgcagaccaactgattcgtctaggagaagtggctaagaaatatcatgtgccactagttaaagtgacaggttcacaacgtgttggtttgtatggagttaaaaaagaagaattaccaaatatatgggaagacctaggtatgcgttcagcatcagcttatggtaagaaaacacgctcagttaaaagctgtgttggtaaagagttttgtcgatttggtacgcaatacacgacacgacttggcattcgtttagaaaaaacatttgaatacatcgatacacctcataaattcaaaatgggtgtatcaggctgcccaagaagttgtgttgaatcaggtgttaaagattttggtattatctcagttgaaaatggattccaaatctatatcggtggtaatggtggtacagaagttgaaaaagctgaatttttaacaactgtagaaacagaagatgaagtaatcaaattatgtggtgctttgatgcaatattatcgcgaaacaggtatatatgctgaaagaacagcgccatggttaagaagacttggatttgaaaatgtaaaagaagtcttacttgacccagaaagacaaaatgaactatttgaacgcattatggatgctaaaaaagcagtcgaagctgaaccttgggaagcaataactagcaatgctcaagcacgtagaatttttgaagtggagaaggtg

SEQ ID NO: 5160 - protein, 801 aa, Staphylococcus aureus
  MISC_FEATURE (1)..(801): nitrite reductase
MAKQKLVMIGNGMAGIRTIEEILERANDLYDITVIGKEPYPNYNRIMLSNILQNKMTVEETIMNPYEWYEEHGIELITNDPVIEVDRANQSVTTANGIEVSYDKLIFATGSKAFVIPVPGSTLPSVIGWRTIDDTEQMMNIAKTKKKAIVIGGGLLGLECARGLLDQGMEVTVLHLAEWLMEMQLDRKAGNMLKADLEKQGMKFEMQANTTEILGEDDVEGVKLADGREIPADLVVMAVGIRPYTEVAKESGLDVNRGIVVNDVMQTSDSNVYAVGECAEHNGKVYGLVAPLYEQGKVLADHLTNKETNGYKGSTTFTSLKVSGCDLYSAGQIVENAEIKGIEIFNSVDNNYKKIFLKDGNVVGAVLYGDIDDGSRFYNMMKKGESTEDYTLVSLLTKGGEEASLSIADMADDETICGCNGVDKGTIVNAITENGFTTVEEVTAKTKAGNSCGKCKPQIAQILQHTLGDDFVAAKPAGICGCTDLTRDQIVTQIRAKGLKTSKEVRHVLNFKNKGGCPKCRPAINYYLNMVYPHDHEDERESRFANERYHANIQNDGTFSVIPQMRGGVTDADQLIRLGEVAKKYHVPLVKVTGSQRVGLYGVKKEELPNIWEDLGMRSASAYGKKTRSVKSCVGKEFCRFGTQYTTRLGIRLEKTFEYIDTPHKFKMGVSGCPRSCVESGVKDFGIISVENGFQIYIGGNGGTEVEKAEFLTTVETEDEVIKLCGALMQYYRETGIYAERTAPWLRRLGFENVKEVLLDPERQNELFERIMDAKKAVEAEPWEAITSNAQARRIFEVEKV

SEQ ID NO: 5161 - DNA, 768 bp, Staphylococcus aureus
atgatttggtatacaatacgtgtgaaagggttggtaaatgtgaatgggaatatcattgttgcacatggcatgaggcacggacgacagaatcaagcgttagaagcatttatttctgaattagtaaaagatgatatacatcactatgatattgcgtttttagaaagtgagcatcaggatttagagacggtaatgacgacgttgattcaaagtggggttgaccattttaaaattgtaccattgctaatctttagtgcaatgcattatctcaaggatataccgaatatcgttcatgaaatgaaacgacggtatccagacataaaggtagaagtaagcgagccacttggcacacatcctttaatgagacgattaattgaacaacgtatttgtgacgcattagcaggtgacgaacaacaagttggagttatggttgttgcacacggcaatattaatggaaagtttactaaggcacacgaagagttacaaatatgcgctcaaaatttgcaaattagcaagccgacatatgcgagaacgctatatggagagattagttttacacatgatttagaaagcatctcgaaacggtatcaaaaattgattgtcgtaccattatttttatatgacggaagacttgttaacaaagtgaagcagcaaatgaatgacatggttattaatacagatatacacttcacaccttcaattaacttcgacccaattttaaagcaaatcattaacgatagattagaaagcttaatgattccaatgaaaata

SEQ ID NO: 5162 - protein, 256 aa, Staphylococcus aureus
  MISC_FEATURE (1)..(256): hypothetical protein
MIWYTIRVKGLVNVNGNIIVAHGMRHGRQNQALEAFISELVKDDIHHYDIAFLESEHQDLETVMTTLIQSGVDHFKIVPLLIFSAMHYLKDIPNIVHEMKRRYPDIKVEVSEPLGTHPLMRRLIEQRICDALAGDEQQVGVMVVAHGNINGKFTKAHEELQICAQNLQISKPTYARTLYGEISFTHDLESISKRYQKLIVVPLFLYDGRLVNKVKQQMNDMVINTDIHFTPSINFDPILKQIINDRLESLMIPMKI

SEQ ID NO: 5163 - DNA, 546 bp, Staphylococcus aureus
gtggggattaatatgacaaaaacgatgattcgactcgcaagtgaacaagatgcagaaaaattgcaacaactcatgcatgaagcatttacgcctctaagagaactaggtattgattggccttcgattaatgctaatttagatgctgttaaagaaaatatagataaaaatactacatttgtcatgacaattgatgatgaaattatatctacgattacggttagatatccttggggaagtgtgaaaagtatttcgggttatccttttgtctggtggtttgcgacaaatcctgagtatgaagggaaaggctatggtagccaattacttacttatgttgaagaagcatttttgcgagatacgttaaagtcagcggcagttactttaggtacatctgcaagattgcatccgtggttacttaaaatttatgaaaaaagaggttatgaaatatacagcgaacatgaaaatgatgatggcgatttaggtgtgatcatgcgcaaagtattgatacccgagcgctttgacgaaacaatattaggccaaccaccattt

SEQ ID NO: 5164 - protein, 182 aa, Staphylococcus aureus
  MISC_FEATURE (1)..(182): conserved hypothetical
VGINMTKTMIRLASEQDAEKLQQLMHEAFTPLRELGIDWPSINANLDAVKENIDKNTTFVMTIDDEIISTITVRYPWGSVKSISGYPFVWWFATNPEYEGKGYGSQLLTYVEEAFLRDTLKSAAVTLGTSARLHPWLLKIYEKRGYEIYSEHENDDGDLGVIMRKVLIPERFDETILGQPPF

SEQ ID NO: 5165 - DNA, 849 bp, Staphylococcus aureus
ttgatcaaagtaaatgggggaagtactgtgatagaaaataagaaaacagttgaagatacatattcaacaggcgcaattgttgattcaatatcatcttcagtacaaatgaagcaagtaatggtacagcaaacacctggccgatatatgcttaaagcaatgatggccggatttttactctcaatcgttactgtatttatgttcggaataaagacgcagtttgcgagtactcacgtagatggacttatcaatttaatgggagccattgcgtttagtttaggtttgattttagttgtattaactaactctgaattattaacaagtaacttcatgtactttacagtaggctggtattataaagtcgtttctgttaagaagatgacttggattttattatattgtttcttaggaaatattttaggtgggtttgtgttatttttcttaatgaaatttgcgcatgtcatgacacctgaaatgacacaagctttaacagctttagttcagaaaaagactgttgattcaacatggttgaatatttttacaaaaggtattttctgtaacttctttattaatattggtattttcatctctatgcaattcaaaggcggcttaacaaaggcattcttcatagcttgtggtgtcgtggtctttgtatacatgggatatgagcacgttgtgttcaatgcaggtctatatgcaggtatggtattctttaaccttgatgcagtttcatggttacacgttttaaaaaatatcgtttttgctttcttaggtaactttgtcggtggcggtatttttgtaggtctcgtttatgctttcttaaatggtaagcgtaatcgtttagagcaacaa

SEQ ID NO: 5166 - protein, 283 aa, Staphylococcus aureus
  MISC_FEATURE (1)..(283): hypothetical protein
LIKVNGGSTVIENKKTVEDTYSTGAIVDSISSSVQMKQVMVQQTPGRYMLKAMMAGFLLSIVTVFMFGIKTQFASTHVDGLINLMGAIAFSLGLILVVLTNSELLTSNFMYFTVGWYYKVVSVKKMTWILLYCFLGNILGGFVLFFLMKFAHVMTPEMTQALTALVQKKTVDSTWLNIFTKGIFCNFFINIGIFISMQFKGGLTKAFFIACGVVVFVYMGYEHVVFNAGLYAGMVFFNLDAVSWLHVLKNIVFAFLGNFVGGGIFVGLVYAFLNGKRNRLEQQ

SEQ ID NO: 5167 - DNA, 804 bp, Staphylococcus aureus
atgaaaaataaattgattatagggcgatatttaccaattaattcttttgttcatcatcttgatccaagagcaaagttaatgtttgtttttctttttattatattaatatttttctgtcattcaccattaacatatctttgggtgtttgcacttatcttattcattatgagattagcaaaaattcaattatggttcctaatcaaaggtttaacaccaatatttttctttttaatcttcacattaatgatgcatatatttttaactaaaggtggatatgtattagttgaatggcatggcatcacgattgaaactaatggtattttagaagggctatatatatcactgcgtttaattgggattgtaatgattgcaacaattatgacactatctacaagtccaattgatttaacagatgcgtttgaaagattacttgcaccactaaagatgtttaaattaccagttcatcaattaagtatgataatgtccattgcgttacgattcatcccgacgttaatggatgagttagataaaatcattttggcgcaaaagtcgcgtggttctgaaataagttcagggaacattgcaacacgtattaaatcatttattccattactagtgccactattcatctcagctttccaacgcgccgaagaattagcggtcgcaatggaagttaggggttatgatgccaatgttaagagaacgagctacagacagcttaaatggcaattgagagatacgatatctttaaccatgattatcccaattgcaattattttattcgtattaaaatattcaggagtg

SEQ ID NO: 5168 - protein, 268 aa, Staphylococcus aureus
  MISC_FEATURE (1)..(268): conserved hypothetical
MKNKLIIGRYLPINSFVHHLDPRAKLMFVFLFIILIFFCHSPLTYLWVFALILFIMRLAKIQLWFLIKGLTPIFFFLIFTLMMHIFLTKGGYVLVEWHGITIETNGILEGLYISLRLIGIVMIATIMTLSTSPIDLTDAFERLLAPLKMFKLPVHQLSMIMSIALRFIPTLMDELDKIILAQKSRGSEISSGNIATRIKSFIPLLVPLFISAFQRAEELAVAMEVRGYDANVKRTSYRQLKWQLRDTISLTMIIPIAIILFVLKYSGV

SEQ ID NO: 5169 - DNA, 195 bp, Staphylococcus aureus
atgagggatgattcgatggtagaacgttatatcaaagttttaatattatatattttcacaacactactatcttctatttcagtaacgtcaaaatgtgtacctaataaagttataaggtttattttacgtactgcaattggttacagtgtatttgcatatggtttacattacttttcaaatttaaaaaagaataag

SEQ ID NO: 5170 - protein, 65 aa, Staphylococcus aureus
  MISC_FEATURE (1)..(65): hypothetical protein
MRDDSMVERYIKVLILYIFTTLLSSISVTSKCVPNKVIRFILRTAIGYSVFAYGLHYFSNLKKNK

SEQ ID NO: 5171 - DNA, 465 bp, Staphylococcus aureus
atgacgattaaagttgaagataataaaattattttttcaagaacgatagaagcaccgattgaaaaggtgtttgatgcctatacgacaaaagcattatttgaaaaatggtttcatccaaaagacgctagtaccaaagtgtttcgctttaatgctgtttcaggcggtgatgcattttatgcgattaaaacacctacaatgaccagctatacattagcagaatataaaacggttaagcgtccatatttaattgaatatattgactcatttgcgacacctcaaggtgcaaaagatacaaaaatgccaagcatgaaaattactttgtcattttccaagagcaatacaacgaaaacgacagtgacatcaacatcggtatttccaacaaaagaagccgctcaacaagtcataaacatgggtgttgaacaaggtatgaatcaaactttagatcaacttgatgctttattgaaa

SEQ ID NO: 5172 - protein, 155 aa, Staphylococcus aureus
  MISC_FEATURE (1)..(155): conserved hypothetical
MTIKVEDNKIIFSRTIEAPIEKVFDAYTTKALFEKWFHPKDASTKVFRFNAVSGGDAFYAIKTPTMTSYTLAEYKTVKRPYLIEYIDSFATPQGAKDTKMPSMKITLSFSKSNTTKTTVTSTSVFPTKEAAQQVINMGVEQGMNQTLDQLDALLK

SEQ ID NO: 5173 - DNA, 1554 bp, Staphylococcus aureus
gtgactatgaaaaagaaattaggtatgttacttcttgtaccagccgtaactttatcattagccgcatgtgggaatgatgatggaaaagataaagatggcaaggtaacaattaaaacgacagtttatccattgcaatcatttgcagagcaaattggtggaaaacacgtgaaggtatcatcaatctatccagcagggacagatttacatagctatgaaccaacacaaaaagatatattaagtgcaagcaagtcagacttgtttatgtatacaggggataatttagatccggttgctaagaaagttgcatctactatcaaagataaagataaaaaactgtctttagaggataaattagataaagcaaagcttttaactgatcaacacgagcatggtgaagagcatgaacatgagggacatgatcatgagaaagaagaacatcatcatcatcatggtggatatgatccacacgtatggttagatcctaaaattaaccaaactttcgctaaagaaattaaagatgaattagtgaaaaaagatccaaaacataaagatgactatgagaaaaactacaaaaaattaaacgacgatcttaagaaaattgataacgatatgaagcaagttacaaaagataagcaaggtaatgcagtattcatttcacatgaatcaattggatacttagctgattgttatggttttgttcaaaaaggtattcaaaacatgaatgctgaagatccatcacaaaaagaattaactaaaattgttaaagaaattagagatagcaatgctaaatatattctttacgaagataatgttgcgaataaagtgactgaaacaattcgtaaagaaacagatgcgaagcctttaaaattctacaacatggagtctttaaataaagaacaacagaaaaaagataatattacgtatcaatcattaatgaaatctaatattgaaaatatcggtaaagctttagacagtggtgttaaagtgaaagacgacaaagctgaaagtaaacatgacaaagcaatttctgatgggtattttaaagatgagcaagttaaagaccgtgaattaagcgattatgctggtgaatggcaatctgtttacccttacttaaaagacggtacgcttgatgaagtgatggaacataaagctgaaaatgatccgaagaaatctgctaaagatttaaaagcttattatgacaaaggatataaaactgatattactaacattgatataaaaggaaatgaaattacatttactaaagatggtaagaaacacactggtaaatatgaatacaatggtaagaaaacattgaaatatcctaaaggtaaccgtggcgtgagatttatgtttaaattggtcgatggtaatgataaagacttaccgaaattcatccaatttagcgatcacaacattgcacctaaaaaggcagaacacttccatatctttatgggtaatgataatgacgcgttattaaaagaaatggataactggccaacatattatccttcaaaattaaataaagaccaaatcaaagaagaaatgttagcgcat

SEQ ID NO: 5174 - protein, 518 aa, Staphylococcus aureus
  MISC_FEATURE (1)..(518): hypothetical protein
VTMKKKLGMLLLVPAVTLSLAACGNDDGKDKDGKVTIKTTVYPLQSFAEQIGGKHVKVSSIYPAGTDLHSYEPTQKDILSASKSDLFMYTGDNLDPVAKKVASTIKDKDKKLSLEDKLDKAKLLTDQHEHGEEHEHEGHDHEKEEHHHHHGGYDPHVWLDPKINQTFAKEIKDELVKKDPKHKDDYEKNYKKLNDDLKKIDNDMKQVTKDKQGNAVFISHESIGYLADCYGFVQKGIQNMNAEDPSQKELTKIVKEIRDSNAKYILYEDNVANKVTETIRKETDAKPLKFYNMESLNKEQQKKDNITYQSLMKSNIENIGKALDSGVKVKDDKAESKHDKAISDGYFKDEQVKDRELSDYAGEWQSVYPYLKDGTLDEVMEHKAENDPKKSAKDLKAYYDKGYKTDITNIDIKGNEITFTKDGKKHTGKYEYNGKKTLKYPKGNRGVRFMFKLVDGNDKDLPKFIQFSDHNIAPKKAEHFHIFMGNDNDALLKEMDNWPTYYPSKLNKDQIKEEMLAH

SEQ ID NO: 5175 - DNA, 264 bp, Staphylococcus aureus
atggctaggttaaatattacgttttcgcctcaagcctttgaagattataagtattttcagcagaacgataaaaaaatggtgaagaagattaatgagttacttaaaagtattgacagaaatggtgcattggaaggtataggtaagcctgaaaagttaaaatcgaatctgactgggtattatagtagacgtatcaatcacgaacatagattggtttatacagtagatgacaatcatataaaaatagcatcatgtaaataccattat

SEQ ID NO: 5176 - protein, 88 aa, Staphylococcus aureus
  MISC_FEATURE (1)..(88): conserved hypothetical
MARLNITFSPQAFEDYKYFQQNDKKMVKKINELLKSIDRNGALEGIGKPEKLKSNLTGYYSRRINHEHRLVYTVDDNHIKIASCKYHY

SEQ ID NO: 5177 - DNA, 249 bp, Staphylococcus aureus
atgattattaaaaattattcatacgctcgacagaatttaaaggcacttatgacaaaagtaaatgatgatagtgatatggtaactgtaacatctactgatgataaaaacgtagtaatcatgtcagaatcagattataactccatgatggaaacactttacctccaacagaacccaaataatgctgaacacttagctcaatcaattgcagatctagaacgtgggaaaactataacgaaagatatagatgta

SEQ ID NO: 5178 - protein, 83 aa, Staphylococcus aureus
  MISC_FEATURE (1)..(83): conserved hypothetical
MIIKNYSYARQNLKALMTKVNDDSDMVTVTSTDDKNVVIMSESDYNSMMETLYLQQNPNNAEHLAQSIADLERGKTITKDIDV

SEQ ID NO: 5179 - DNA, 597 bp, Staphylococcus aureus
atgactaaaaaattactaacattatttatagtgagcatgttaattttaacagcttgcggtaaaaaagaatcagcaacgacatcttcgaaaaacggcaaaccattagttgtcgtatatggcgactataaatgtccttattgtaaagaattagatgaaaaagtcatgccaaagttgcgtaaaaattatatagataatcacaaagtggaataccaatttgtcaatttagctttcttaggtaaagactcaattgttggttcgcgtgcgagtcatgcagtattgatgtatgcacctaaatcatttttagattttcaaaagcaattatttgctgcccagcaagatgaaaataaagaatggttaacaaaagaactattagataaacatattaaacaactgcatttagataaagagacggaaaataaaattataaaagattacaagacaaaagatagcaagtcttggaaagctgcagagaaagataaaaaaatagcgaaagataatcatataaaaacgacaccaactgcatttattaatggcgagaaagttgaagatccatatgattatgaaagttatgagaagttattaaaagataaaatcaaa

SEQ ID NO: 5180 - protein, 199 aa, Staphylococcus aureus
  MISC_FEATURE (1)..(199): conserved hypothetical
MTKKLLTLFIVSMLILTACGKKESATTSSKNGKPLVVVYGDYKCPYCKELDEKVMPKLRKNYIDNHKVEYQFVNLAFLGKDSIVGSRASHAVLMYAPKSFLDFQKQLFAAQQDENKEWLTKELLDKHIKQLHLDKETENKIIKDYKTKDSKSWKAAEKDKKIAKDNHIKTTPTAFINGEKVEDPYDYESYEKLLKDKIK

SEQ ID NO: 5181 - DNA, 399 bp, Staphylococcus aureus
ttgaaagttagttggaagttgatagtaggagtgggagcattgaagcgatttgtggcgacggtattattattactagtctttatatcaggatgtggtaatgataaatatgtgaaagaaatagatgaagcagttaaaattcaaaatcaaaaacaagaacaacttgccaaaaaaggcaacggtgatcgtgttgatcattttgaacgcaaagatgctaatatttatgtctatgataaggataaaattatcattttagcttataaacctttgagtaatgatgatgaagtgcattattatgcatatgattttagtgataaacgtgtatcatataagcaagattttgattcgagacgatattatcaacaacatgatgcggattatcatgaagaaaatatgacgaac

SEQ ID NO: 5182 - protein, 133 aa, Staphylococcus aureus
  MISC_FEATURE (1)..(133): hypothetical protein
LKVSWKLIVGVGALKRFVATVLLLLVFISGCGNDKYVKEIDEAVKIQNQKQEQLAKKGNGDRVDHFERKDANIYVYDKDKIIILAYKPLSNDDEVHYYAYDFSDKRVSYKQDFDSRRYYQQHDADYHEENMTN

SEQ ID NO: 5183 - DNA, 1248 bp, Staphylococcus aureus
atgaactttgtaacgttgacttcggatgagttcaatgcgtttacaacaaagcatttttcacattacacacaatcagctattcattacaatcatagagttgatttaaaaggcgatgtgcatcttgtaggggttaaagatgacaatggtcaagtgattgcaggatgcttattgacagaagcacgcacacttaaatttttcaaatatttttatacacatcgcgggccagtgatggattatacaaatcaatcattagtagcatttttctttaaagcattaacgtcatatttaaagaaacacaattgtttatatgtccttgtagatccatatttaattgaaaatttacgcaatgcagacggtgaaattgttaaatcttatgataaccgagcatttgttagaacaatggataaattaggttataaacaccaaggtttccctgtaggttatgattcaatgagccaaatccgttggctgtcagtgttagatttaaaagataagactgaagaccaacttttaaaagaaatggattatcaaacgagacgtaatattaaaaaaacatatgatattggtgtcaaaactaaaacgttaacgattgatgaaacgcaaacttttttcgacttattccatatggctgaggaaaagcacggtttcaaattccgtgagttaccatactttgaagaaatgcaaaagttatacgatgaccacgccatgttaaagttggcgtatattgatttaaacgagtatttaaaaacgttacaattaaagcaacaacaattaacagctgaactctcaggtgttgaagaagcattggaagaaagtcctaattcaaagaaaaataaaacgaaacgcacacagctagaacaacagctaaatagcaataagcgtaaaatcgacaatacaatagaacaaattgaacaagatggtgcagtcttaaacttagcttctgctttatttatctacaatgagcatgaagtttattacttatctagtggttcaaaccctaaatataatgcttatatgggtgcctaccatttgcagtgggaaatgattaagtttgctaaagcgcatcatattgatcgctataatttttatggtattaccggtgacttttcagagtcatcagaagactatggcgtccaacaattcaaaaaaggttttaacgcacatgtagaagagtatatcggtgactttattaagcctatcaaaccattactatataaggtacaaacgtacttaaatcataaacgtcgt

SEQ ID NO: 5184 - protein, 416 aa, Staphylococcus aureus
  MISC_FEATURE (1)..(416): fmhA protein
MNFVTLTSDEFNAFTTKHFSHYTQSAIHYNHRVDLKGDVHLVGVKDDNGQVIAGCLLTEARTLKFFKYFYTHRGPVMDYTNQSLVAFFFKALTSYLKKHNCLYVLVDPYLIENLRNADGEIVKSYDNRAFVRTMDKLGYKHQGFPVGYDSMSQIRWLSVLDLKDKTEDQLLKEMDYQTRRNIKKTYDIGVKTKTLTIDETQTFFDLFHMAEEKHGFKFRELPYFEEMQKLYDDHAMLKLAYIDLNEYLKTLQLKQQQLTAELSGVEEALEESPNSKKNKTKRTQLEQQLNSNKRKIDNTIEQIEQDGAVLNLASALFIYNEHEVYYLSSGSNPKYNAYMGAYHLQWEMIKFAKAHHIDRYNFYGITGDFSESSEDYGVQQFKKGFNAHVEEYIGDFIKPIKPLLYKVQTYLNHKRR

SEQ ID NO: 5185 - DNA, 729 bp, Staphylococcus aureus
atgattcaattgaacaatatccataaatcatttaatgatgttgaagtcatcaaaggtattgatttatctgttgaacaaggtgaggttgtaaccttaatcggtcgatctggttcaggtaaaacaacattgttacgtatgattaatgcattagaaattccaactgaaggtacagtttatgttaacggcaaaacatatacatctaaagataaaaaatcacaaatagaagttcgtaaacagtctggtatggtatttcaaagttataacctttttccgcataagacggcattagaaaatgtaatggaaggtcttatcacagttaaaaagttgaaaaaggatgaggcacgtgggaaatcacttgagttacttgagaaagttggtttaacacatgtcaaagatcaacgtccacatgcattatcaggtggtcaacaacaacgtgttgctattgcaagagcactagcaatgaaccctaaagtgatgttgtttgatgaaccaacatctgcacttgatcctgaacttgtgaatgatgttttaaaggttattaaagatttggctaatgaaggcatgacaatggtcattgtgacacatgaaatgcgttttgctaaagaagtatctaataacattgtatttattcatgaaggcatgatcggagaacaaggggctccagaagagatgttcaatcgtccgaaaacagaagaattaagacgtttcttaaatgttataaatgaagaa

SEQ ID NO: 5186 - protein, 243 aa, Staphylococcus aureus
  MISC_FEATURE (1)..(243): hypothetical protein
MIQLNNIHKSFNDVEVIKGIDLSVEQGEVVTLIGRSGSGKTTLLRMINALEIPTEGTVYVNGKTYTSKDKKSQIEVRKQSGMVFQSYNLFPHKTALENVMEGLITVKKLKKDEARGKSLELLEKVGLTHVKDQRPHALSGGQQQRVAIARALAMNPKVMLFDEPTSALDPELVNDVLKVIKDLANEGMTMVIVTHEMRFAKEVSNNIVFIHEGMIGEQGAPEEMFNRPKTEELRRFLNVINEE

SEQ ID NO: 5187 - DNA, 726 bp, Staphylococcus aureus
ttggtcaagatgtttctaaatctaaatagcgaacaacaacatgcgctagatgctgcaaaacaagctttcggacctatgctagaaggtttggtcaaatattcaattcctattacattagttacatttgttttaggattgattattgcattatttacagcattaatgcgaatttcaacgagtaaaattttaagaagtatttcacgtgtctatgtatctattattcgaggaacaccaatgatagtacaactatttatcatattttatggtattccagaattaggtagattattaacaaatgacgctgacaaccaatggacattggcacctgtagtggctgctattattggtttatcattaaatgtaggtgcgtatgcttcggaaattattcgtggcggtattatttctataccgaaaggacaaacagaagctgcatattccatcggtatgacgtatggtcaaacgatacaacgtatcattttaccgcaggcaattcgagtgtcgattcctgcactaggtaatacatttttaagtttaatcaaagatacatcattattaggatttattttagtggctgaaatgtttagaaaagctcaagaagttgcgtctacaacatatgaatatttaacaatttatgtgttagttgcgctaatgtactgggtggtatgctttattatttcaattatccaaggtatctatgaatcttatattgaaagagggtatcgctca

SEQ ID NO: 5188 - protein, 242 aa, Staphylococcus aureus
  MISC_FEATURE (1)..(242): hypothetical protein
LVKMFLNLNSEQQHALDAAKQAFGPMLEGLVKYSIPITLVTFVLGLIIALFTALMRISTSKILRSISRVYVSIIRGTPMIVQLFIIFYGIPELGRLLTNDADNQWTLAPVVAAIIGLSLNVGAYASEIIRGGIISIPKGQTEAAYSIGMTYGQTIQRIILPQAIRVSIPALGNTFLSLIKDTSLLGFILVAEMFRKAQEVASTTYEYLTIYVLVALMYWVVCFIISIIQGIYESYIERGYRS

SEQ ID NO: 5189 - DNA, 858 bp, Staphylococcus aureus
atgactatacggtttgacaatgtaagttatacctatcaaaaagggacaccatatcagcatcaagctattcatgatgttaatacagaatttgaacaaggtaaatattacgccatcgttggacaaacgggtagtggtaaatcaacgttgatacaaaatattaatgcgctgttaaagccgactactgggacagttacagttgatgacattactattacacataagaccaaagataaatatattagacctgtaagaaaaagaattggaatggtatttcaatttcccgaatctcaattatttgaggacacagtagagcgtgaaatgatatttggacctaaaaactttaaaatgaatttagatgaagccaaaaactatgcccatcgtctgttgatggatttaggcttttcaagagatgtaatgtcacaatcaccatttcaaatgtcaggtggacaaatgcgtaaaatagcgattgtatcgatattggcaatgaatcctgatattatcgtggttgatgaacctacagcaggacttgatccacaaagtaaacgacaagtaatgagattactaaagtcactacaaacagatgaaaataaggcaattatcctaatttcacatgatatgaatgaagtcgcgcgttatgcagatgaagtcatcgttatgaaagaaggtagtatagtgtcgcaaacatcaccaaaagagctcttcaaagataaaaaaaaattggcggattggcatattggtttgccagaaattgttcagttacaatatgactttgaacaaaaatatcaaacaaaattaaaagatattgccttaactgaagaagcatttgtaagcttgtataaggagtggcaacatgaaaaa

SEQ ID NO: 5190 - protein, 286 aa, Staphylococcus aureus
  MISC_FEATURE (1)..(286): hypothetical protein
MTIRFDNVSYTYQKGTPYQHQAIHDVNTEFEQGKYYAIVGQTGSGKSTLIQNINALLKPTTGTVTVDDITITHKTKDKYIRPVRKRIGMVFQFPESQLFEDTVEREMIFGPKNFKMNLDEAKNYAHRLLMDLGFSRDVMSQSPFQMSGGQMRKIAIVSILAMNPDIIVVDEPTAGLDPQSKRQVMRLLKSLQTDENKAIILISHDMNEVARYADEVIVMKEGSIVSQTSPKELFKDKKKLADWHIGLPEIVQLQYDFEQKYQTKLKDIALTEEAFVSLYKEWQHEK

SEQ ID NO: 5191 - DNA, 777 bp, Staphylococcus aureus
atgaaaagacttttatttgtgatgatagctttcgttttcatattggctgcatgcggaaacaattcgtcgaaagacaaggaagctagtaaagatagcaagacaattaatgttgggactgaggggacttatgcaccatttagtttccacgataaagatggtaaattaactggttacgatattgatgttattaaagcagtggctaaagaagaaggtttaaaacttaaatttaatgaaacttcttgggattctatgtttgcaggtttagacgcagggcgttttgatgtaatcgcgaaccaagtaggtattaatcctgatagagaaaagaaatataaattttctaagccttacacattctcaagtgctgttttagttattcgtgaaaatgaaaaagatattaaagattttgatgatgttaaaggtaagaagttagcacaaacattcacatctaattatggtaaattagctaaggataaaggtgctgatattacaaaagttgatggctttaaccaatcaatggatttattattgtctaagcgtgttgatggtacatttaatgatagtctgtcatacttggattataaaaaacaaaaacctaatgctaagatcaaagcaatcaaaggtaatgctgaacaaagtagatctgcatttgcattttctaaaaaagcagatgatgaaacagttcaaaaattcaatgatggcttgaaaaaaatcgaggaaaacggtgaattagctaaaataggtaagaaatggtttggtcaagatgtttctaaatctaaa

SEQ ID NO: 5192 - protein, 259 aa, Staphylococcus aureus
  MISC_FEATURE (1)..(259): hypothetical protein
MKRLLFVMIAFVFILAACGNNSSKDKEASKDSKTINVGTEGTYAPFSFHDKDGKLTGYDIDVIKAVAKEEGLKLKFNETSWDSMFAGLDAGRFDVIANQVGINPDREKKYKFSKPYTFSSAVLVIRENEKDIKDFDDVKGKKLAQTFTSNYGKLAKDKGADITKVDGFNQSMDLLLSKRVDGTFNDSLSYLDYKKQKPNAKIKAIKGNAEQSRSAFAFSKKADDETVQKFNDGLKKIEENGELAKIGKKWFGQDVSKSK

SEQ ID NO: 5193 - DNA, 1395 bp, Staphylococcus aureus
atgggtggattttttggattattaaatgaaacactattagtgacggctttaccaagtattatgaaagattttgaaatttcatatacacaagttcaatggctgacaacagcttttttattgactaatgggattgttattcctttgtccgcgcttgttatacaacgttatacaacaagacaagtgtttttagtgggtatttctatctttttcttaggtacattactcggcggcttgagtccgcactttgcaacattattagttgctagaattattcaggcgttaggcgcaggtattatgatgccattgatgatgacaacgattttggatgttttccaaccacatgaacgcggtaaatatatggggatatttggtttggtaattggtttagcaccagctattggacctactctttcaggttaccttgttgaatattttaactggagatcgcttttccatgttgtcgctccaattgcagctgtgacatttttaattggatttaaaacgataaaaaatgttggaactacaattaaagtacctattgattttatttctgtcattttttctgtactaggtttcggcgggttattgtatggaacgagttcaatttcagaaaaaggttttgataatcctatcgtattagtatctatgattggaggcgttgttttagtcgcattatttgtattacgtcaatatcggctatcaacaccattattaaattttgctgtatttaaaaataaacaatttacagttggtatcattattatgggtgtcacaatggtatcgatgattggttcggaaacgattttacctatctttgtgcaaaatttattgcatcgttcagctttagattctggattaactttattaccaggagcaattgttatggcatttatgtcgatgacttcgggtgctttatatgaaaagtttggtcctagaaatcttgctttagtaggtatggcgattgttgttattactacggcttattttgttgtaatggatgaacaaacatcaacaatcatgttggcaacagtttatgcgattcgaatggttggtatcgcgttaggattaattccagtaatgacccatacgatgaatcaattaaagccagaaatgaatgcacatggttcatctatgacaaacacagtacaacaaattgctggttctatcggaacagctgcattaattactattttatcccatgcaagcaaaaacttttctccaactatgtcagactataatggcatgaacaaaattgatatgatgaatcaaattaaagttgatacgatgttgcatggttatcacgctggatttttatttgcattattgattacagttgttagtttcttttgttcatttatgttacaaggtaagaaaaaagaagttgattctcgtcaa

SEQ ID NO: 5194 - protein, 465 aa, Staphylococcus aureus
  MISC_FEATURE (1)..(465): hypothetical protein
MGGFFGLLNETLLVTALPSIMKDFEISYTQVQWLTTAFLLTNGIVIPLSALVIQRYTTRQVFLVGISIFFLGTLLGGLSPHFATLLVARIIQALGAGIMMPLMMTTILDVFQPHERGKYMGIFGLVIGLAPAIGPTLSGYLVEYFNWRSLFHVVAPIAAVTFLIGFKTIKNVGTTIKVPIDFISVIFSVLGFGGLLYGTSSISEKGFDNPIVLVSMIGGVVLVALFVLRQYRLSTPLLNFAVFKNKQFTVGIIIMGVTMVSMIGSETILPIFVQNLLHRSALDSGLTLLPGAIVMAFMSMTSGALYEKFGPRNLALVGMAIVVITTAYFVVMDEQTSTIMLATVYAIRMVGIALGLIPVMTHTMNQLKPEMNAHGSSMTNTVQQIAGSIGTAALITILSHASKNFSPTMSDYNGMNKIDMMNQIKVDTMLHGYHAGFLFALLITVVSFFCSFMLQGKKKEVDSRQ

SEQ ID NO: 5195 - DNA, 141 bp, Staphylococcus aureus
ttggaaaatgggtataattaccggatatctaaaaatgtgtgtcgttttttagatggtgagggggaagctttaaatgtcgaagaaacaaaaattaacgatgattattactatgctgatgggtggattttttggattattaaa

SEQ ID NO: 5196 - protein, 47 aa, Staphylococcus aureus
LENGYNYRISKNVCRFLDGEGEALNVEETKINDDYYYADGWIFWIIK

SEQ ID NO: 5197 - DNA, 102 bp, Staphylococcus aureus
atgaaattagatttacagactgctcgtcgtaatttaaatagccctaacattaaaacaagaaagcgtgctttaaagattattaagcaacataaaagagcgaaa

SEQ ID NO: 5198 - protein, 34 aa, Staphylococcus aureus
MKLDLQTARRNLNSPNIKTRKRALKIIKQHKRAK

SEQ ID NO: 5199 - DNA, 684 bp, Staphylococcus aureus
atgccaaaattaattttatgtcgtcatggacaaagcgagtggaatgctaaaaacttatttactggatgggaagatgttaatttatctgaacaaggtattaatgaagcgactagagcaggtgaaaaagtaagagaaaataacattgccatcgatgtagcttttacatcgttattaacacgtgctttagatacaacgcattatattttaactgaatctaaacaacaatggattcctgtatataaaagctggcgtttaaatgaacgccactatggtggattgcaaggcttaaataaagatgatgctagaaaagaatttggagaagaacaagtacatatttggcgtcgttcttatgatgtgaaaccacctgctgaaaccgaagaacaacgtgaagcttacttagctgatcgtcgatataatcatttagataaacgtatgatgccttattctgaaagtctgaaagatactttagttcgagtgataccattttggacagatcatatttcacaatatttgctagatggtcaaacggtattagtttctgcacacggaaattcaattcgcgcattgattaaatatcttgaagatgtgtcagatgaagatatcattaattatgaaattaaaacaggtgcaccgcttgtttatgaattaacggatgatttagaagttatagataaatactactta

SEQ ID NO: 5200 - protein, 228 aa, Staphylococcus aureus
  MISC_FEATURE (1)..(228): phosphoglycerate mutase
MPKLILCRHGQSEWNAKNLFTGWEDVNLSEQGINEATRAGEKVRENNIAIDVAFTSLLTRALDTTHYILTESKQQWIPVYKSWRLNERHYGGLQGLNKDDARKEFGEEQVHIWRRSYDVKPPAETEEQREAYLADRRYNHLDKRMMPYSESLKDTLVRVIPFWTDHISQYLLDGQTVLVSAHGNSIRALIKYLEDVSDEDIINYEIKTGAPLVYELTDDLEVIDKYYL

SEQ ID NO: 5201 - DNA, 876 bp, Staphylococcus aureus
gtggttcaacgcatgtctcataatgaaaatcttaaattggcgcaacgcggtgcttatttgagtttaattgtatatataatcttatctattgttaagtatgtcacgggttttgtctttaactctgcagctgtaagagccgatgcattaaacaatatgacagatattatcgtttctttagctgttattattggattgaaaatttcaattaaacctgccgatcgaaatcatccttatggccatttgaagtctgaaaatatttcttcattattggtgtcatttgtcattatgtttgtaggtatccaagtagttattcaaaatgcacctcgtttgttcaaagaagatgacgttgtacctaacgcaataacaattatcgtcagcttaatcagtggtcttgtaatgttgattgtatttgcagtcaatcaaagactagcgaaaagaacgaaaagtagttctttaaattcggctgccaaagataatttatcggatagtttagtcagcattggaacagcgataggattaatttttacgcaaatcggtttcccaattgtcgatattattttagcaacattactaggcttactaatcgtttatactggttttggtatttttaaagaagcaatttttatgttgagtgatggtttcaatgaaactgaattagaagcgtatcgcaatgatattttagaagttgatgaagtacaagaagttaaaagtattaaagggcgttaccatggaagtagtgtgtttattgatgtcacaattgttgtagatgctaacctttccttagtagaagcgcatcaaatttgtgacaatgtcgaacatcatttgcacaaaaaaggtatttcctcagtatacgttcacccagaaccagaccatcta

SEQ ID NO: 5202 - protein, 292 aa, Staphylococcus aureus
  MISC_FEATURE (1)..(292): conserved hypothetical
VVQRMSHNENLKLAQRGAYLSLIVYIILSIVKYVTGFVFNSAAVRADALNNMTDIIVSLAVIIGLKISIKPADRNHPYGHLKSENISSLLVSFVIMFVGIQVVIQNAPRLFKEDDVVPNAITIIVSLISGLVMLIVFAVNQRLAKRTKSSSLNSAAKDNLSDSLVSIGTAIGLIFTQIGFPIVDIILATLLGLLIVYTGFGIFKEAIFMLSDGFNETELEAYRNDILEVDEVQEVKSIKGRYHGSSVFIDVTIVVDANLSLVEAHQICDNVEHHLHKKGISSVYVHPEPDHL

SEQ ID NO: 5203 - DNA, 102 bp, Staphylococcus aureus
atgttaactaatagattaactagtgttaactatgtaaaaaagcgtttaattcagaacattcagcgtattttaagtaaggaagtactatatggagaaatgcaa

SEQ ID NO: 5204 - protein, 34 aa, Staphylococcus aureus
MLTNRLTSVNYVKKRLIQNIQRILSKEVLYGEMQ

SEQ ID NO: 5205 - DNA, 1308 bp, Staphylococcus aureus
atgaaaaataaatatatctcgaagttgctagttggggcagcaacaattacgttagctacaatgatttcaaatggggaagcaaaagcgagtgaaaacacgcaacaaacttcaactaagcaccaaacaactcaaaacaactacgtaacagatcaacaaaaagctttttatcaagtattacatctaaaaggtatcacagaagaacaacgtaaccaatacatcaaaacattacgcgaacacccagaacgtgcacaagaagtattctctgaatcacttaaagacagcaagaacccagaccgacgtgttgcacaacaaaacgctttttacaatgttcttaaaaatgataacttaactgaacaagaaaaaaataattacattgcacaaattaaagaaaaccctgatagaagccaacaagtttgggtagaatcagtacaatcttctaaagctaaagaacgtcaaaatattgaaaatgcggataaagcaattaaagatttccaagataacaaagcaccacacgataaatcagcagcatatgaagctaactcaaaattacctaaagatttacgtgataaaaacaaccgctttgtagaaaaagtttcaattgaaaaagcaatcgttcgtcatgatgagcgtgtgaaatcagcaaatgatgcaatctcaaaattaaatgaaaaagattcaattgaaaacagacgtttagcacaacgtgaagttaacaaagcacctatggatgtaaaagagcatttacagaaacaattagacgcattagttgctcaaaaagatgctgaaaagaaagtggcgccaaaagttgaggctcctcaaattcaatcaccacaaattgaaaaacctaaagtagaatcaccaaaagttgaagtccctcaaattcaatcaccaaaagttgaggttcctcaatctaaattattaggttactaccaatcattaaaagattcatttaactatggttacaagtatttaacagatacttataaaagctataaagaaaaatatgatacagcaaagtactactataatacgtactataaatacaaaggtgcgattgatcaaacagtattaacagtactaggtagtggttctaaatcttacatccaaccattgaaagttgatgataaaaacggctacttagctaaatcatatgcacaagtaagaaactatgtaactgagtcaatcaatactggtaaagtattatatactttctaccaaaacccaacattagtaaaaacagctattaaagctcaagaaactgcatcatcaatcaaaaatacattaagtaatttattatcattctggaaa

SEQ ID NO: 5206 - protein, 436 aa, Staphylococcus aureus [sequence omitted]

SEQ ID NO: 5207 - DNA, 963 bp, Staphylococcus aureus
atgaacttaaaattaaatagaaagaaagtgatttctatgattaaaaataaaatattaacagcaactttagcagttggtttaatagcccctttagccaatccatttatagaaatttctaaagcagaaaataagatagaagatatcggccaaggtgcagaaatcatcaaaagaacacaagacattactagcaaacgattagctataactcaaaacattcaatttgattttgtaaaagataaaaaatataacaaagatgccctagttgttaagatgcaaggcttcattagctctagaacaacatattcagacttaaaaaaatatccatatattaaaagaatgatatggccatttcaatataatatcagtttgaaaacgaaagactctaatgttgatttaattaattatcttcctaaaaataaaattgattcagcagatgttagtcagaaattaggctataatatcggcggaaacttccaatcagcgccatcaatcggaggcagtggctcattcaactactctaaaacaattagttataatcaaaaaaactatgttactgaagtagaaagtcagaactctaaaggtgttaaatggggagtgaaagcaaattcattcgttacaccgaatggtcaagtatctgcatatgatcaatacttatttgcacaagacccaactggtccagcagcacgagactatttcgtcccagataatcaactacctcctttaattcaaagtggctttaatccatcatttattacaacattgtcacacgaaagaggtaaaggtgataaaagcgagtttgaaatcacttacggcagaaacatggatgctacatatgcttacgtgacaagacatcgtttagccgttgatagaaaacatgatgcttttaaaaaccgaaacgttacagttaaatatgaagtgaactggaaaacacatgaagtaaaaattaaaagcatcacacctaag

SEQ ID NO: 5208 - protein, 321 aa, Staphylococcus aureus
  MISC_FEATURE (1)..(321): gamma-hemolysin chain II
MNLKLNRKKVISMIKNKILTATLAVGLIAPLANPFIEISKAENKIEDIGQGAEIIKRTQDITSKRLAITQNIQFDFVKDKKYNKDALVVKMQGFISSRTTYSDLKKYPYIKRMIWPFQYNISLKTKDSNVDLINYLPKNKIDSADVSQKLGYNIGGNFQSAPSIGGSGSFNYSKTISYNQKNYVTEVESQNSKGVKWGVKANSFVTPNGQVSAYDQYLFAQDPTGPAARDYFVPDNQLPPLIQSGFNPSFITTLSHERGKGDKSEFEITYGRNMDATYAYVTRHRLAVDRKHDAFKNRNVTVKYEVNWKTHEVKIKSITPK

SEQ ID NO: 5209 - DNA, 918 bp, Staphylococcus aureus
atgagtcagaaaatactagtaatatatagagaacccagtcaatgtcatatacagcgatttataaatattgtaaaatatgatagatacacgaatcgtaaaggagagagacaagtggaggataagaattcagttattgtatttaaaaatgtttcatttcaatatcaaagtgatgcatccttcacattgaaagatgtttcttttaatatacctaaaggtcagtggacatctattgttggtcataacggttctggaaaatctacaattgccaagttaatgattggcatagagaaagttaaatctggagaaattttttataataatcaagctataactgatgataattttgaaaagttaagaaaagacataggaattgtatttcagaatccggataatcaatttgttggttcaattgtaaaatacgatgtggcatttggactcgaaaatcatgcggttccatatgacgaaatgcatagaagagtcagcgaagcacttaaacaagttgatatgttagaacgtgcagattatgaacctaatgcattatcggggggacagaagcagcgtgtggctatagcaagtgtattagcacttaacccctctgtcattatattagatgaggcgacttctatgttagatcctgatgcacgtcaaaatttattggatttagtgagaaaagttaaatcagaacataatattacaatcatttctattacgcatgatttatctgaggcgatggaagcagatcatgttatcgttatgaataaagggactgtctataaagaaggcacagcgactgaaattttcgacaatgcagaagagttaacaagaataggtctagatttgccattcccaatcaaaataaatcaaatgctgggacaccaaacatcattcttaacttatgaagggctggtggatcaacta

SEQ ID NO: 5210 - protein, 306 aa, Staphylococcus aureus
  MISC_FEATURE (1)..(306): hypothetical protein
MSQKILVIYREPSQCHIQRFINIVKYDRYTNRKGERQVEDKNSVIVFKNVSFQYQSDASFTLKDVSFNIPKGQWTSIVGHNGSGKSTIAKLMIGIEKVKSGEIFYNNQAITDDNFEKLRKDIGIVFQNPDNQFVGSIVKYDVAFGLENHAVPYDEMHRRVSEALKQVDMLERADYEPNALSGGQKQRVAIASVLALNPSVIILDEATSMLDPDARQNLLDLVRKVKSEHNITIISITHDLSEAMEADHVIVMNKGTVYKEGTATEIFDNAEELTRIGLDLPFPIKINQMLGHQTSFLTYEGLVDQL

SEQ ID NO: 5211 - DNA, 375 bp, Staphylococcus aureus
atgaatgttggaggtgacatgatgaaattaggtatgcttttaattagatggatgttagcaacatcattcttagtgcatggtactttgaaatttgttgatttagatggaacaattcacttcttaggctctttaggtttaccacctaccatcgcagtattgatgtcaattggtgaagttgttggaggtttagcacttattatcggctttttaacgccttatgttaatgttttttatatttgtgttatgttaggctcaatcttcacacttaaacttacaagaggatatgtaagtggttatgaatttgaaatcatacatatcgtaatgaacttagcttgtattagtagttacagctggaagaaatggctacaattttat

SEQ ID NO: 5212 - protein, 125 aa, Staphylococcus aureus
  MISC_FEATURE (1)..(125): conserved hypothetical
MNVGGDMMKLGMLLIRWMLATSFLVHGTLKFVDLDGTIHFLGSLGLPPTIAVLMSIGEVVGGLALIIGFLTPYVNVFYICVMLGSIFTLKLTRGYVSGYEFEIIHIVMNLACISSYSWKKWLQFY

SEQ ID NO: 5213 - DNA, 954 bp, Staphylococcus aureus
gtgaaacttatgcttaaaaataaaatattaactacaactttatctgtgagcttacttgcccctcttgccaatccgttattagaaaatgctaaagctgctaacgatactgaagacatcggtaaaggaagcgatatagaaattatcaaaaggacagaagataaaacaagtaataaatggggcgtgactcaaaatattcaatttgattttgtaaaggataaaaaatataacaaagatgctttgatattaaagatgcaaggattcattagctctagaacaacatattacaactataaaaaaactaatcatgttaaagctatgcgatggccattccaatataatattggtttaaaaacaaatgataaatatgtttctttaattaattatttacctaaaaataaaattgaatctacaaacgtgagtcagacattaggatacaatatcggtggtaatttccaatcagccccatcactcggtggtaatggatcatttaactattctaaatcgattagctatacacaacaaaattatgtaagtgaagtagaacaacaaaactcaaaaagtgttttatggggcgtcaaagcgaattcattcgccactgaatcaggtcaaaaatcagcctttgatagcgatttatttgtaggctacaaacctcatagtaaagatcctagagattatttcgttccagacagtgagttaccacctcttgtacaaagtggatttaacccttcatttatcgccacagtatctcatgaaaaaggttcaagcgatacaagcgaatttgaaattacttacggaagaaacatggatgtcactcatgccattaaaagatcaacgcattatggcaacagttatttagacggacatagagtccataatgcatttgtaaatagaaactatactgtgaaatacgaggtcaattggaagactcatgaaatcaaggtgaaaggacagaat

SEQ ID NO: 5214 - protein, 318 aa, Staphylococcus aureus
  MISC_FEATURE (1)..(318): gamma-hemolysin component C
VKLMLKNKILTTTLSVSLLAPLANPLLENAKAANDTEDIGKGSDIEIIKRTEDKTSNKWGVTQNIQFDFVKDKKYNKDALILKMQGFISSRTTYYNYKKTNHVKAMRWPFQYNIGLKTNDKYVSLINYLPKNKIESTNVSQTLGYNIGGNFQSAPSLGGNGSFNYSKSISYTQQNYVSEVEQQNSKSVLWGVKANSFATESGQKSAFDSDLFVGYKPHSKDPRDYFVPDSELPPLVQSGFNPSFIATVSHEKGSSDTSEFEITYGRNMDVTHAIKRSTHYGNSYLDGHRVHNAFVNRNYTVKYEVNWKTHEIKVKGQN

SEQ ID NO: 5215 - DNA, 975 bp, Staphylococcus aureus
atgaaaatgaataaattagtcaaatcatccgttgctacatctatggcattattattactttctggtactgctaatgctgaaggtaaaataacaccagtcagcgtaaaaaaagtcgatgacaaagttactttatacaaaacaacagccacagcagattctgataaatttaaaatttcacagattttaacatttaatttcatcaaagataaaagttatgataaagatactttagtacttaaagctactgggaatattaactcaggctttgtgaaacctaatcctaatgactatgacttttcaaaattatattggggagctaaatacaatgtatctataagctcacaatctaatgattcagtaaacgtcgttgattatgcaccaaaaaatcaaaatgaagagtttcaagttcaaaatactttaggctatacatttggtggtgacattagtatctctaatggtttatctggtggacttaatggaaatacagctttttctgaaacaattaattataaacaagaaagttacagaacaacattaagtcgcaacacaaattataaaaatgttggctggggagttgaagcacataaaattatgaataatggttggggaccttatggaagagatagcttccacccaacatatggtaatgaactcttcttagctggcagacaaagcagtgcatacgctggccaaaacttcatagcgcaacaccaaatgccattattatctagaagtaacttcaatccagaatttttaagcgtactatcacacagacaagatggcgctaaaaaatctaaaattacagtaacttatcaacgtgaaatggatttataccaaattcgttggaatggcttctactgggcaggcgcaaattataaaaactttaaaactagaacatttaaatcaacatatgaaattgattgggaaaatcacaaagtgaaattgttagatacaaaagaaactgaaaacaataaa

SEQ ID NO: 5216 - protein, 325 aa, Staphylococcus aureus
  MISC_FEATURE (1)..(325): gamma-hemolysin component B
MKMNKLVKSSVATSMALLLLSGTANAEGKITPVSVKKVDDKVTLYKTTATADSDKFKISQILTFNFIKDKSYDKDTLVLKATGNINSGFVKPNPNDYDFSKLYWGAKYNVSISSQSNDSVNVVDYAPKNQNEEFQVQNTLGYTFGGDISISNGLSGGLNGNTAFSETINYKQESYRTTLSRNTNYKNVGWGVEAHKIMNNGWGPYGRDSFHPTYGNELFLAGRQSSAYAGQNFIAQHQMPLLSRSNFNPEFLSVLSHRQDGAKKSKITVTYQREMDLYQIRWNGFYWAGANYKNFKTRTFKSTYEIDWENHKVKLLDTKETENNK

SEQ ID NO: 5217 - DNA, 411 bp, Staphylococcus aureus
ttggcagttttgaaaataccgtccattataccaggattagattttcaattatctgcaccggcagcattattgatattagctttctttggaattaaaaagtactttttaggtggattattatctagcctattattactagtatttggcgtatttaatccaattaatgtgattatctctattatatttagagttatagctattgcagttgtttatttattgaaaataaatgtactatcattagttttagcaagtgtattaggcagtttggtatctaggctactattatctattattttaaatttacctgtgtgggtagtgttgttaaacgcgattccaggcgtaatattcactttaattgtagctattcctttatatctcacattgagaaaaagaatggcagtattactaaga

SEQ ID NO: 5218 - protein, 137 aa, Staphylococcus aureus
  MISC_FEATURE (1)..(137): hypothetical protein
LAVLKIPSIIPGLDFQLSAPAALLILAFFGIKKYFLGGLLSSLLLLVFGVFNPINVIISIIFRVIAIAVVYLLKINVLSLVLASVLGSLVSRLLLSIILNLPVWVVLLNAIPGVIFTLIVAIPLYLTLRKRMAVLLR

SEQ ID NO: 5219 - DNA, 726 bp, Staphylococcus aureus
ttgaaattttgcatcaagaagattgaggtgatcgtcatgtatagtataaaaatgcgttctagcaatcaagatgttcatattagtggtgctgaaacgatttgtgagtttgacaaaatagaacagacggtacaaaggttttataataaaggtttttttcatgaaaatgggcaaccggattttctcaatataaaaatacaaaaaatcatggaaccgattcaacaaataaaagcattacaaattattgaggatgataaagcaaatctccaacatttaacacaagaatgtggtgtcactgaacaagcgctaaatcaagggatgacatatattaaaaatgaaacggtttatacaggagctattattctatctgctatatctggtaaacgtttagattcatttggacaaagggggattagggcaacacatttttcgtttgaagatataaataataaaggtgatcttaatgaaagagtgactgatgccttagcaattgctagttgtatcaatgcgcatccgtatgtcaaaggagaactttgcgtgtccgatgacttaacgtatacgacaggttattttgccgctgctaaaattggttaccatcgattatttgatattaaaccagttaatacgagatatggaggcagaataatatttgtggacgattgtattgatttaaatcattacatatcatttttagaaagcacaccgaagcaagttgtttatgaaacggta

SEQ ID NO: 5220 - protein, 242 aa, Staphylococcus aureus
  MISC_FEATURE (1)..(242): hypothetical protein
LKFCIKKIEVIVMYSIKMRSSNQDVHISGAETICEFDKIEQTVQRFYNKGFFHENGQPDFLNIKIQKIMEPIQQIKALQIIEDDKANLQHLTQECGVTEQALNQGMTYIKNETVYTGAIILSAISGKRLDSFGQRGIRATHFSFEDINNKGDLNERVTDALAIASCINAHPYVKGELCVSDDLTYTTGYFAAAKIGYHRLFDIKPVNTRYGGRIIFVDDCIDLNHYISFLESTPKQVVYETV

SEQ ID NO: 5221 - DNA, 1155 bp, Staphylococcus aureus
ttgaaattgattatgacacttgtgaaaataaggaaaacaagaatgaagtttcaagagcaaattgatttattacaacagaaagggttatatcggtcgcttaaatcggtagggtatatagatagacagtatattgaagtagaaaataagagatgtacgaactatacatctaatgattatttaggattaggtcaaatagcgtttgataaggatgatttcgaaagatttatgcggaagtatagttatcacttatcaagttcaagattaattagtggaagttcgacagcttatgaagaaattgaaacaatgttagcaggttggctcggatatagtgcatgtactatcttaaatagtggttatgatgctaatttggcgttatttaatattttcaaaaatacaaattgtgtcgtgttttcagatcaagaaaatcatgcgagtattattgacggtattaagttaagtggtttagaaaaagtgatatataagcatttagatattgctgatttagaaaaaaggttagagaaataccctaatcaaaatataccaaaaataatcatatctgatagtgtattttcaacgaatggcgacgttgtggatattggtcaattagtctcattaaagcataaatataacgcaacactgatactcgatgtttcacatagttttggaatagagaattactcgaattatcaaggtgtagatatactcacttctagtttatctaaagcatgtggtgcatacgggggtgtgattttaagttcaaatgatgtgaaggatatgttaattaatcacggtagaccactcatctactcaagtagtttgccaatttataatttgtattttataaaaagaaacattgaaaagttaataaatgctgatgatagacgcactaaattaaatagtttgagtaaatattttaaccaaaagttaaaagcactcaatgttaattataatagttcaaactcgccgattaagtttattgagtttgatgacatagaagcggctgagaacattcatcaaacattattaaagcatcatgtgtttacaagttatttaaggtatccaactgtgactaagccaatgttaagaatatcattgtcgtattttcatactgaacaagatatagataggttgtttgaaattttgcatcaagaagat

SEQ ID NO: 5222 - protein, 385 aa, Staphylococcus aureus
  MISC_FEATURE (1)..(385): hypothetical protein
LKLIMTLVKIRKTRMKFQEQIDLLQQKGLYRSLKSVGYIDRQYIEVENKRCTNYTSNDYLGLGQIAFDKDDFERFMRKYSYHLSSSRLISGSSTAYEEIETMLAGWLGYSACTILNSGYDANLALFNIFKNTNCVVFSDQENHASIIDGIKLSGLEKVIYKHLDIADLEKRLEKYPNQNIPKIIISDSVFSTNGDVVDIGQLVSLKHKYNATLILDVSHSFGIENYSNYQGVDILTSSLSKACGAYGGVILSSNDVKDMLINHGRPLIYSSSLPIYNLYFIKRNIEKLINADDRRTKLNSLSKYFNQKLKALNVNYNSSNSPIKFIEFDDIEAAENIHQTLLKHHVFTSYLRYPTVTKPMLRISLSYFHTEQDIDRLFEILHQED

SEQ ID NO: 5223 - DNA, 1005 bp, Staphylococcus aureus
atgaatttggctaaacgcatattacaaggggaacaattaacaaaagagactgtattgaaaatttatgaggatactaatattgataccttagatttattaaatgaggcgtacattttaagaaaacattattttggtaaaaaagtaaaattaaacatgattttaaatgctaaaagtggtatatgtcctgaaaattgtgggtactgtggacaatcacgagatattaaacaaaaacagcgatatgctttaattccagaggaacaaattatcgatggagcaaaggtggcacatgataatcatattggaacatattgtattgttatgagtggtagaggaccgagcgataaagaagttgatcatattagtaatactgtaagaacgattaaatctcaacacccgcaactaaaaatctgtgcatgtttaggattaacgaatgacgaacaagctaagaaacttaagtcagctggtgtagacagatataaccacaatattaatacaagtgaaaattaccatgataacgtcgtgacaacgcatagttataaagatagaacagatacgatagaactaatgaaagcgaataatatatcaccatgttctggcgtgatttgtggtatgggagaatctaatcaagatattgttgatatggcatttgctttaaaagaaatggatgccgacagtattccgattaattttttgcatccaatcaaaggcacaaagtttggaagcatggatgatttaacaccaatgaaatgtttaagaatcgtagcattattccgattaatcaatcctacgaaagaaattcgtattgctggaggaagagaggtcaacttacgttcgttacagccattagcattaaaagcggcgaattcaatatttgtcggtgattatctaattactggtgggcaaccgaaccaattagactacgatatgattaatgatttaggctttgaaattgattatgacacttgtgaaaataaggaaaacaagaatgaagtttcaagagcaaat

SEQ ID NO: 5224 - protein, 335 aa, Staphylococcus aureus
  MISC_FEATURE (1)..(335): biotin synthase
MNLAKRILQGEQLTKETVLKIYEDTNIDTLDLLNEAYILRKHYFGKKVKLNMILNAKSGICPENCGYCGQSRDIKQKQRYALIPEEQIIDGAKVAHDNHIGTYCIVMSGRGPSDKEVDHISNTVRTIKSQHPQLKICACLGLTNDEQAKKLKSAGVDRYNHNINTSENYHDNVVTTHSYKDRTDTIELMKANNISPCSGVICGMGESNQDIVDMAFALKEMDADSIPINFLHPIKGTKFGSMDDLTPMKCLRIVALFRLINPTKEIRIAGGREVNLRSLQPLALKAANSIFVGDYLITGGQPNQLDYDMINDLGFEIDYDTCENKENKNEVSRAN

SEQ ID NO: 5225 - DNA, 1356 bp, Staphylococcus aureus
atgaattacacacaacaacttaaacaaaaagactcagaatatgtttggcatccatttacacaaatgggtgtatatagcaaagaagaagcaatcatcattgaaaaaggaaagggtagttacctttacgatacgaatggcaataaatatttagatggttatgcatcgttgtgggtcaatgtgcatggtcataataacaaatacttaaataaggtaattaaaaagcaactcaataaaattgcccattctacgctgctaggatcatcaaatattccgtcaatagaacttgcggaaaaattaatcgaaatcacgccaagtaatctaagaaaagtattttattctgatacaggcagtgcgtctgttgaaatcgcaataaagatggcatatcagtattggaaaaatattgatagagaaaaatatgccaagaaaaacaagtttataacgctaaatcacggttatcatggggatacgattggtgcggtaagtgttggtggtatcaagacctttcataaaatatttaaagacttaatatttgagaatattcaagtagaaagcccatctttctatcgcagtaattacgatactgaaaatgaaatgatgacagctattttaacgaatatagagcaaattctaattgaaagaaatgatgaaatcgcagggtttatattggaaccgttgattcaaggtgcgacaggcttgtttgttcatcctaaaggctttttgaaagaagtcgagaaattgtgcaaaaaatacgatgtcttattaatttgtgatgaggtagcagttggttttgggagaactggaaagatgtttgcatgcaatcatgaagatgttcaaccggatattatgtgtttaggtaaggcgattactggtggctacttaccacttgcagctacattgacatctaaaaaaatatacaatgcatttttaagtgattcgcatggtgtgaatacctttttccatggtcatacatacaccggaaatcaaatcgtttgtacggttgcattagaaaatataagactttatgaaaaacgtaagttattgtcacatattgaaacgacatcatcaacacttgagaaacagttacatgcgctgaagcgtcatcgaaatgttggtgatgtaagaggacgaggcttaatgtttggagttgaattagttacagataaagatagtaaaacgccgttagaaattgaaaaagttgaacgtattgtacgtaattgtaaagaaaacgggctaatgattagaaatttagaaaatgtcattacgtttgtgccagtgttaagtatgtcaaataaagaagtgaaaacgatggtacgtatttttaaaaaggcagtacataacattttagataggaagtgt

SEQ ID NO: 5226 - protein, 452 aa, Staphylococcus aureus
MNYTQQLKQKDSEYVWHPFTQMGVYSKEEAIIIEKGKGSYLYDTNGNKYLDGYASLWVNVHGHNNKYLNKVIKKQLNKIAHSTLLGSSNIPSIELAEKLIEITPSNLRKVFYSDTGSASVEIAIKMAYQYWKNIDREKYAKKNKFITLNHGYHGDTIGAVSVGGIKTFHKIFKDLIFENIQVESPSFYRSNYDTENEMMTAILTNIEQILIERNDEIAGFILEPLIQGATGLFVHPKGFLKEVEKLCKKYDVLLICDEVAVGFGRTGKMFACNHEDVQPDIMCLGKAITGGYLPLAATLTSKKIYNAFLSDSHGVNTFFHGHTYTGNQIVCTVALENIRLYEKRKLLSHIETTSSTLEKQLHALKRHRNVGDVRGRGLMFGVELVTDKDSKTPLEIEKVERIVRNCKENGLMIRNLENVITFVPVLSMSNKEVKTMVRIFKKAVHNILDRKC

SEQ ID NO: 5227 - DNA, 696 bp, Staphylococcus aureus
gtggttatttttatgaggatttttattacaagtacgaatactgatgtaggcaaaacctatgttacaaagcatttataccatgctttgaaaacacgtggtcatcgagtttgtatttttaaaccatttcaaactgaggaacgccaagacgggacgtttccagatttagaagtatttaaaaatgaatgtgatttaagctatgacataacgtcactttatacttttaagcaacctgtatcaccacaccttgcatttaaaatgacagatcaaatttttctaaataagcagcgtgtattagataaggtaaaagttttagataaggaatttgattttatcttaattgagggtgctgggggaattgccgtaccaatatatgaaggtacagatgatttctacatgactaaagatctaatcaatgattgtgcagattgtgtcatcagtgtgttgccatcaaaattaggtgctattagcgatgccattgttcaccaagattatgttaatcagaatgtatcggcgagtaattttttaataatgaatcgctatacagacagctatattgaaaaagacaatcaaatgacgattggaaaattaacaaataaaacagtctatacatttgaagaacatgccacgtatgaaaatttctcagaagcatttttaaaacaattaataggagttaaaaatgaattacacacaacaact

SEQ ID NO: 5228 - protein, 232 aa, Staphylococcus aureus
  MISC_FEATURE (1)..(232): dethiobiotin synthetase
VVIFMRIFITSTNTDVGKTYVTKHLYHALKTRGHRVCIFKPFQTEERQDGTFPDLEVFKNECDLSYDITSLYTFKQPVSPHLAFKMTDQIFLNKQRVLDKVKVLDKEFDFILIEGAGGIAVPIYEGTDDFYMTKDLINDCADCVISVLPSKLGAISDAIVHQDYVNQNVSASNFLIMNRYTDSYIEKDNQMTIGKLTNKTVYTFEEHATYENFSEAFLKQLIGVKNELHTTT

SEQ ID NO: 5229 - DNA, 1731 bp, Staphylococcus aureus
atgtttcaaattacatttaaaattttaaactggataagaccatataaagcaagaatgattttaggatttagcatgtcatttttaaatgctatttttattgcgttacctatctttttagctgcaaaaatatttaataatgtgctatctcataaacctatttatatgaaagatatattgaatgttgtaattatcatggttttattagtgattggacgatttattacagcatatttcaaaagcaaaagccatgagagcatcgcttatgaaatgagtgcgaaagaacgtttagatataggggataaattgaaaaatgtaaggttaggttattttaattcgcatcattcaaatgagttaacaacaatagtaacaacagatttaacctttttagaaaactttgctatgaaaatggtggacgttgttgttaatggatacatattaattacagtactcatattgtctctacttgtagtttcgtggcaagtatcattattagcatgcattggcgtattactatcattttttgcgattcaattattagaaagaaagagtcgacaaaatgcgccagcgtatcataatgtacaaaaccaattagtggaaaaggtattggaggttattcgtggtattcaagtaataaaatcattcgcgaaagaaaatacgagtcttaaaagttttaaccaagcagtcaatgaaagtaaacgtataaatacaaaaatagaaatgcaatatatcccattcaatttattgcatttacttagtttaaaagttgtttcaataatgattgtattagttgcatgcttattatatatgaatcatagtattgatttacctacccttattatgatttcaattttttcatttgtgatatttgatagtgttgaaaatattaatagtgctgcacacgtacttgaaatgatagatatgacgatagatgatattgaaaagataaaaaatgctccagaactggatgagaatggaaaaaatttgacgattaaaaatgaaaatatcgcttttcaaaacgtgaacttttcatatgatgataaacaagtgataaagaatgtgaattttgagatacctacacaaacatcaacagcaataattggaccttcaggaagtgggaaatctacattatgtcacttactcttgcgcttttatgatatcgatgatggaaatattcgcatcgatggtgttgatattaaagatatgacattaagtacgttaatgtcgaaaattagtgcagtatttcaaaaggtgtatttatttaatgatacgattgaaaataacatattgtttggcaatccaggtgcaacgaaagaagaaattattcgtgcagcgaagcaagcatgttgccacgacttcatcatgtcattacctgagggatatcaaacaatgctaaatgaaaaaggtagtaatttatctggcggagaaaagcaaaggatttctattgctagggcgatattaaaagatgcaccaataattattttagatgaagcaactgcaagtattgaccctgaaaatgaacagctgattcaaacggcaattaatgaattaagtaaaggcaaaacagtaattacaattgcacataaacttgaaactattaaaaatgcagatcagattatagtgctcaatgaaggtgaaataattcaaaaaggtagtcatgatgaattaattcgaaaaccaggaatgtatcaagactttataagaataaaaagtaaatcagcaggctggaaatta

SEQ ID NO: 5230 - protein, 577 aa, Staphylococcus aureus
  MISC_FEATURE (1)..(577): hypothetical protein
MFQITFKILNWIRPYKARMILGFSMSFLNAIFIALPIFLAAKIFNNVLSHKPIYMKDILNVVIIMVLLVIGRFITAYFKSKSHESIAYEMSAKERLDIGDKLKNVRLGYFNSHHSNELTTIVTTDLTFLENFAMKMVDVVVNGYILITVLILSLLVVSWQVSLLACIGVLLSFFAIQLLERKSRQNAPAYHNVQNQLVEKVLEVIRGIQVIKSFAKENTSLKSFNQAVNESKRINTKIEMQYIPFNLLHLLSLKVVSIMIVLVACLLYMNHSIDLPTLIMISIFSFVIFDSVENINSAAHVLEMIDMTIDDIEKIKNAPELDENGKNLTIKNENIAFQNVNFSYDDKQVIKNVNFEIPTQTSTAIIGPSGSGKSTLCHLLLRFYDIDDGNIRIDGVDIKDMTLSTLMSKISAVFQKVYLFNDTIENNILFGNPGATKEEIIRAAKQACCHDFIMSLPEGYQTMLNEKGSNLSGGEKQRISIARAILKDAPIIILDEATASIDPENEQLIQTAINELSKGKTVITIAHKLETIKNADQIIVLNEGEIIQKGSHDELIRKPGMYQDFIRIKSKSAGWKL

SEQ ID NO: 5231 - DNA, 1782 bp, Staphylococcus aureus
ttgaaaggagttacatatacgatgaacaatcagacaaattggataaagatactcagcggatttgcttctgatagtaaatggaaaattatgttatcaattttgttgtctatcatcagtgtcttttctggattagttccttattgggcagtatttaaaattattttaatgatgattaacaatacatatacgattaattcgattatggtttatatctttattgctttaatcgcttatatttcacaagtgtgttgttttggagcgtcaacgatgctatcacatattacggcatatgaaattttatctgaaattcgtaaaaaattagctcaaaaattaatgcgtctccctttaggcgtagtggaatctaagaaaataggtgaattaaaaaatatatttgtcgataaggttgaaacaatagaattacctttagcacatatgattcctgaagttataggaaacttacttttgtcagctgctatctttttatacataatgctcattgattggcgtatggctagtgccttattagtaacgataccaatttcaattttcgcttttaaaaaagttatgtctggatttaatgagacatatgctgaacaaatgaaatcgaataattatatgaatagcgcgattgtagagtttatcgaaggcattgaagtgattaaaacatttaatcaatctcaaagttcatataaaaaatataaagatgcagtagataattataagattcacactttgaattggtttaaaaatacatgggggtatatgaatttaggagctagtgtattaccttcaacatttttagggattttaccggtcggcatgtatttgatatctatcaaccaattaaactatgcggaatttttcctatgcatcgtattatctttaggtgtagtagcaccgattaagaattttactaattatgtaaatcatttaaagtctatacaatacgcattaactgaagtgaatcaaatattaagtctagaagagttagtattgtcaacaaaatttaagaagcctcaacattatgaaattgcttttaataatgttggattttcatataacaaagataaggacgatctggtctttaagcatttatcatttacagtaccagaaaataatttcacagctatcgtcggggcatctggtagcggtaagtcaaccattgccaagcttatatcacgatactgggatgtgacttcaggtgaaattacgattggcggtataaatataaaagatattgaatcgaaacaacttaacgatttagttggttttgttggacaagataactttttattaaatcttacttttaaagaaaatattaaacttggcaatccagaagctacggatgaggcagttgaaaaagctgccaagttagcacaatgtcatgaatttattgaaaagttgccagatggatatgatacgaatgttggtacagtgggagataaattgtctggtggtgaaaaacaacgagtcactattgcaagaatgatattaaaagatgcgcctatcattgtattagatgaagcgactgtttacgttgatccagacaacgaacaaaaaattcaagaagcattaaatgtgttgacgcaggataaaacattgattgttattgcacatcggttatctacgattcaacatgcagatcaaattattgttttaggtaaacaacaaattttagaaaaagggtcacatcacttattgctaaaattaaacggtaattataagaaaatgtgggatacgcacatgcatacaaaagattggggaatcaatactggacataat

SEQ ID NO: 5232 - protein, 594 aa, Staphylococcus aureus
  MISC_FEATURE (1)..(594): hypothetical protein
LKGVTYTMNNQTNWIKILSGFASDSKWKIMLSILLSIISVFSGLVPYWAVFKIILMMINNTYTINSIMVYIFIALIAYISQVCCFGASTMLSHITAYEILSEIRKKLAQKLMRLPLGVVESKKIGELKNIFVDKVETIELPLAHMIPEVIGNLLLSAAIFLYIMLIDWRMASALLVTIPISIFAFKKVMSGFNETYAEQMKSNNYMNSAIVEFIEGIEVIKTFNQSQSSYKKYKDAVDNYKIHTLNWFKNTWGYMNLGASVLPSTFLGILPVGMYLISINQLNYAEFFLCIVLSLGVVAPIKNFTNYVNHLKSIQYALTEVNQILSLEELVLSTKFKKPQHYEIAFNNVGFSYNKDKDDLVFKHLSFTVPENNFTAIVGASGSGKSTIAKLISRYWDVTSGEITIGGINIKDIESKQLNDLVGFVGQDNFLLNLTFKENIKLGNPEATDEAVEKAAKLAQCHEFIEKLPDGYDTNVGTVGDKLSGGEKQRVTIARMILKDAPIIVLDEATVYVDPDNEQKIQEALNVLTQDKTLIVIAHRLSTIQHADQIIVLGKQQILEKGSHHLLLKLNGNYKKMWDTHMHTKDWGINTGHN

SEQ ID NO: 5233 - DNA, 366 bp, Staphylococcus aureus
atgggttacagaaaattaggtcgtacttctgatcaacgtaaagctatgttacgtgacttagctacatcacttattattagtgaacgtattgaaactacagaagctcgtgcaaaagaagttcgcagtgttgttgagaaattaatcactttaggtaaaaaaggagatttagcttctcgtcgtaatgcagctaaaactttacgtaatgttgaaatcttaaacgaagatgaaactacacaaactgcacttcaaaaattatttggtgaaatcgcagagcgttacacagaacgtcaaggtggttacactcgtatccttaaacaaggccctcgtcgcggtgacggtgctgaatcagtaattatcgaattagta

SEQ ID NO: 5234 - protein, 122 aa, Staphylococcus aureus
  MISC_FEATURE (1)..(122): 50S ribosomal protein L17
MGYRKLGRTSDQRKAMLRDLATSLIISERIETTEARAKEVRSVVEKLITLGKKGDLASRRNAAKTLRNVEILNEDETTQTALQKLFGEIAERYTERQGGYTRILKQGPRRGDGAESVIIELV

SEQ ID NO: 5235 - DNA, 105 bp, Staphylococcus aureus
atggcagtagtgaggggatttggtgtatttagatgttcaatttattatgtaattaattatagcattgatgaacaaggtgtgcaatgtatttttgcaatattacaa

SEQ ID NO: 5236 - protein, 35 aa, Staphylococcus aureus
MAVVRGFGVFRCSIYYVINYSIDEQGVQCIFAILQ

SEQ ID NO: 5237 - DNA, 105 bp, Staphylococcus aureus
atgttcaatttattaattaacatcatgacttcagctataagcggctgtcttgttgcgttttttgcacattggttacgaacgcgcaacaataaaaaaggtgacaaa

SEQ ID NO: 5238 - protein, 35 aa, Staphylococcus aureus
MFNLLINIMTSAISGCLVAFFAHWLRTRNNKKGDK

SEQ ID NO: 5239 - DNA, 384 bp, Staphylococcus aureus
atgaaactaacacaaacgcatgctgaaattttaaaatttatcattgttggcggcattaatacgttaaattattatgttgtctatttattgctgttaaaattattacacattgaatatatgattagtcatattaccggatttctagtcgcttttgtgatttcatattatttgaattgttattttgtttacagggtaaaacctacttggagaaaattcattagttttccaattacgcagattgtcaacgtaagcttacaaacagttttattatatgtatttgtatcctggctaaatttgccagcagaaattgcaccatttgctggtttaattattacgatacccatcacatttatattatctaaatggattttaaaagatagcaat

SEQ ID NO: 5240 - protein, 128 aa, Staphylococcus aureus
  MISC_FEATURE (1)..(128): conserved hypothetical
MKLTQTHAEILKFIIVGGINTLNYYVVYLLLLKLLHIEYMISHITGFLVAFVISYYLNCYFVYRVKPTWRKFISFPITQIVNVSLQTVLLYVFVSWLNLPAEIAPFAGLIITIPITFILSKWILKDSN

SEQ ID NO: 5241 - DNA, 1149 bp, Staphylococcus aureus
atgtctactatgcaattacaaaaaattgtcatcgctcctgactcatttaaggaaagtatgaccgcacagcaagttggcaatattataaaacaggcttttactaatgtttatgggaatacccttcattatgatatcattccgatggctgatggtggtgaaggtaccacagatgctttaatgcatgcaacaggtgccactaagtatacagtcatcgttaatgaccctttaatgcgacctattgaagcatgttatgcacgcgcagacgaacaacaaattgcaattattgaaatggcggcagcgtcaggtttggatttattagaaaaagaggaacgtaatcctttatacacatcatcatatggtaccggtgaactaattaaagatgcattaaatcatggtgctaagaccattattttagggattggtggcagtgcaacaaatgatggtggtacaggtatgctaagtgcactaggcgtaaagtttactgatgtaaacggggacttattacaaatgaatggtgctaatcttgctcacattgcacaaatcgatataaccaatctagattcgcgattaaaagaggtgacctttaaagtggcctgtgatgtttcaaatcctttattgggtgaaaatggtgctacctatatttatggtcctcaaaaaggcgctgatgcaaagatgataccaaagttggatttcgcaatgtcgcattatcatgataagataaaaatgtgcacaggaaagtccgttaatcaaataccaggttctggtgcagctggcggtatgggcgcagcattattagcgttttgtgagacaactttaacaaaaggtattgatgtcgtctttgacattacagattttcatcaaagaattaaagatgcagacctcgttattactggagaaggacgcatggattatcagaccatctttggtaaaacacccgtaggcgttgcgttagctgcaaaacaatatcatattcctgtcatcgcgatttgtggcagtctaggcgaaaattatcaacatgtttacgatttcggtattgatagtgcctattctataatctcttcacctagcactttagaagatgtcctacaaaatagcgaacaaaatttattaaacactgcaactgacattgctcgtattctgaaattacaa

SEQ ID NO: 5242 - protein, 383 aa, Staphylococcus aureus
  MISC_FEATURE (1)..(383): conserved hypothetical
MSTMQLQKIVIAPDSFKESMTAQQVGNIIKQAFTNVYGNTLHYDIIPMADGGEGTTDALMHATGATKYTVIVNDPLMRPIEACYARADEQQIAIIEMAAASGLDLLEKEERNPLYTSSYGTGELIKDALNHGAKTIILGIGGSATNDGGTGMLSALGVKFTDVNGDLLQMNGANLAHIAQIDITNLDSRLKEVTFKVACDVSNPLLGENGATYIYGPQKGADAKMIPKLDFAMSHYHDKIKMCTGKSVNQIPGSGAAGGMGAALLAFCETTLTKGIDVVFDITDFHQRIKDADLVITGEGRMDYQTIFGKTPVGVALAAKQYHIPVIAICGSLGENYQHVYDFGIDSAYSIISSPSTLEDVLQNSEQNLLNTATDIARILKLQ

SEQ ID NO: 5243 - DNA, 675 bp, Staphylococcus aureus
ttgaatgaggtgaaacccatgaaaagaactgataaataccgtgattcatatcaatacgacaatcaaaaccaaaatcatcgtcgtcaatctgaagacgcatcgtatagacaacaatatgctaaaggcgatcctgaagaacacccggaacgatactataatggtagagattatcgaagagaacaaattcttgaagaagaaaacgagaaatcccgccgttcaaaaaaatggttatatatcattattgccattctcttaattattgtcgctatttttgtcacacgcgccttacttaacaatgatagcgataaagttagtaatgaccctaaagtctctcaaaattataaaaaacaagttgaaaatcaagacggccaaattaaccagcaagtagataatgctaaagaaaatattaaaaacaaccaaaaaactgatgacattattaaaaatttacaaaatcaaatcgacaacttgaagcagcaagaacaaaacaaagctgattctaagctaactcaattttatcaagaccaaatcaacaaattgacagaggcaaataatgcacttaaaaacaatgcaagccaaggtaaaattgaaagcatgttaaatgatattaatacaaaattcgacagtattaaatctaaattagaaagcttatttaaagatgacaatggtggcgctaat

SEQ ID NO: 5244 - protein, 225 aa, Staphylococcus aureus
  MISC_FEATURE (1)..(225): hypothetical protein
LNEVKPMKRTDKYRDSYQYDNQNQNHRRQSEDASYRQQYAKGDPEEHPERYYNGRDYRREQILEEENEKSRRSKKWLYIIIAILLIIVAIFVTRALLNNDSDKVSNDPKVSQNYKKQVENQDGQINQQVDNAKENIKNNQKTDDIIKNLQNQIDNLKQQEQNKADSKLTQFYQDQINKLTEANNALKNNASQGKIESMLNDINTKFDSIKSKLESLFKDDNGGAN

SEQ ID NO: 5245 - DNA, 1209 bp, Staphylococcus aureus
atgcaatcaacgaaaaccaaaacgaagcatttttcatttttattgctaattacgttaggcgtcatgaccgcttttggcccactaactatagatatgtacgtaccatcattacctaaagtgcaaggtgattttggttctactacatcagaaattcaattaacattatcattcacaatgattggtcttgcactaggccaatttatctttggacctttatccgatgcttttggtcgcaaacggattgctgtatccattttgatcattttcattttggtatcaggtttgtctatgtttgttgatcaattgccattattcttaactttacgatttattcaaggtttaactggtggtggcgtcatcgtgattgcaaaagcctctgctggtgataaatttagtggcaacgcactcgctaaatttttagcatctttaatggtagttaatggcatcatcactattcttgcaccattagccggtggattagctttatccgtagcaacatggcgttctattttcacaattttaactattgtggcactcatcattttaattggcgtcgcttctcaattacctaaaacatctaaagatgaattaaagcaggtgaattttagtagcgtcattaaagattttggaagtcttttgaaaaaaccagcatttattattccaatgctattacaaggtttaacttatgtaatgctatttagttattcatctgcatcgccatttattactcaaaaattgtataatatgacaccccaacaatttagtatcatgtttgctgttaacggtgtaggtttaatcattgtcagtcaagtcgttgctttattagtagaaaaattacatcgccacatattattaatcattttaactattatacaagtggtaggtgttgctttaattatcctgacacttacattccatttaccactttgggtcttactcatcgcattcttcttaaatgtgtgtcctgtgacgtcaattggaccgcttggtttcacaatggctatggaagaacgaacaggtggcagtggtaacgcatcaagtttacttggcttattccaatttatcttaggtggcgctgttgcaccattagttggcttaaaaggcgaatttaatacatcaccatatatgattattatcttcattacagccattctattagtcagtctacaaatcatttactttaaaatgattaaaaagcaacatgtcgca

SEQ ID NO: 5246 - protein, 403 aa, Staphylococcus aureus
  MISC_FEATURE (1)..(403): hypothetical protein
MQSTKTKTKHFSFLLLITLGVMTAFGPLTIDMYVPSLPKVQGDFGSTTSEIQLTLSFTMIGLALGQFIFGPLSDAFGRKRIAVSILIIFILVSGLSMFVDQLPLFLTLRFIQGLTGGGVIVIAKASAGDKFSGNALAKFLASLMVVNGIITILAPLAGGLALSVATWRSIFTILTIVALIILIGVASQLPKTSKDELKQVNFSSVIKDFGSLLKKPAFIIPMLLQGLTYVMLFSYSSASPFITQKLYNMTPQQFSIMFAVNGVGLIIVSQVVALLVEKLHRHILLIILTIIQVVGVALIILTLTFHLPLWVLLIAFFLNVCPVTSIGPLGFTMAMEERTGGSGNASSLLGLFQFILGGAVAPLVGLKGEFNTSPYMIIIFITAILLVSLQIIYFKMIKKQHVA

SEQ ID NO: 5247 - DNA, 471 bp, Staphylococcus aureus
atggaatatcaattacaacaacttgcgtcgttaacgttagtaggtattaaagaaacgtatgaaaatggacgacaggctcagcaacatatagcagggttttggcaaagatgttatcaagagggagtaattgcggatttacagttaaaaaataatggtgatttagccgggatacttggcttatgtatacctgaattagacggtaagatgtcatatatgattgcagttaccggagataatagtgctgatattgaaaaatatgatgtcataacattagcaagttcaaagtatatggtatttgaagcacagggcgcagtacctaaagcagttcaacaaaaaatggaagaggttcatcactacatacatcaatatcaagcagatacggtaaaatcagcaccattttttgagttgtatcaggatggtgatactacaagtgaaaaatatattacagaaatttggatgcctgttaaaggg

SEQ ID NO: 5248 - protein, 157 aa, Staphylococcus aureus
  MISC_FEATURE (1)..(157): hypothetical protein
MEYQLQQLASLTLVGIKETYENGRQAQQHIAGFWQRCYQEGVIADLQLKNNGDLAGILGLCIPELDGKMSYMIAVTGDNSADIEKYDVITLASSKYMVFEAQGAVPKAVQQKMEEVHHYIHQYQADTVKSAPFFELYQDGDTTSEKYITEIWMPVKG

SEQ ID NO: 5249 - DNA, 678 bp, Staphylococcus aureus
ttgaatcaatgcgaggactatattatgaaccgaaaaatattaccagttaaacctatcagtcagctatttcctatccctatggtcatggggtgtgaaggtgtttccgcagccatgatgttgcaatacaacaaccaacatatccctgctacagaaattatgagacattggccgacacatccgaacaatccacataaaggttatgttggacatcacttattcattaagcttggcaattatcatcaaacgatatttccagaagcatatgtaccatttttacaaaaatacaatcctaatatcgtagacggcactggtaaatcgttagaagatcttaaaggtattatcgatcaaggtcaacctgtgttaatataccatactaatcttggttctaaaccattactacgtgttttccgctttgataacaagccagcgaaacaagtttcaaatattcacgtaacgttactcattgggtacgatgattactattactattatatcgatccactttggagtcatattcgtcgtggcctagttttacctgccatcattccaaatcgcaaacaaattattaaaattcgtaaagagaaaatggaatacagctttaattcaccaggaagaaagtgcatttatgtgcaaccacattcatatacaattgaaaatcagcaacaaaataaacacacg

SEQ ID NO: 5250 - protein, 226 aa, Staphylococcus aureus
  MISC_FEATURE (1)..(226): hypothetical protein
LNQCEDYIMNRKILPVKPISQLFPIPMVMGCEGVSAAMMLQYNNQHIPATEIMRHWPTHPNNPHKGYVGHHLFIKLGNYHQTIFPEAYVPFLQKYNPNIVDGTGKSLEDLKGIIDQGQPVLIYHTNLGSKPLLRVFRFDNKPAKQVSNIHVTLLIGYDDYYYYYIDPLWSHIRRGLVLPAIIPNRKQIIKIRKEKMEYSFNSPGRKCIYVQPHSYTIENQQQNKHT

SEQ ID NO: 5251 - DNA, 825 bp, Staphylococcus aureus
ttgagtaaagaaggtaagggtatgaagatagggacaatcgccgatttacatattgatcgtcataataaaaaaacatccgaagattacttagaggcattggttgaaatagttaagtataagaaattggatatattgttgattgcgggggatatctcaaatcattatcaattgacgcaccaatttataacgcaattgacaaaacaattagatatacctgtgaaatttgtacctggaaaccatgatttatgggaagttgaaagtatgactacgcaagacatttggaataattataagagtatgtcacagtgcttggtaggaaaaccatttatagtaaatgaagaatgggcaatcataggacatactggctggtatgattatagctttgcagcacaacgattttcattagatgagttacaaaaaggaaaacattatggtgcgacttggcaagataaagaacgaatatcttggggcatatcagatcaaaatttatctaaaatagcggctgaacaagtgaagaaagatatattagaagtaggaaatagacgagtgattttagtcacacatgttgtgacgcaccctgatttcattgttcctatgccgcatcgtatattcgatttttataatgcatttattgggacaagtgatttcaatcctttgtatgcgatgttcgatataccatatagtattatgggccatgttcattttcgtaaaagtgtgatagatgatggcagatgttatctctgtccgtgtctaggctatccaagacaatggcgttcagaagatatttaccaggaaataaatgagacgatacaaataatagaaatt

SEQ ID NO: 5252 - protein, 275 aa, Staphylococcus aureus
  MISC_FEATURE (1)..(275): conserved hypothetical
LSKEGKGMKIGTIADLHIDRHNKKTSEDYLEALVEIVKYKKLDILLIAGDISNHYQLTHQFITQLTKQLDIPVKFVPGNHDLWEVESMTTQDIWNNYKSMSQCLVGKPFIVNEEWAIIGHTGWYDYSFAAQRFSLDELQKGKHYGATWQDKERISWGISDQNLSKIAAEQVKKDILEVGNRRVILVTHVVTHPDFIVPMPHRIFDFYNAFIGTSDFNPLYAMFDIPYSIMGHVHFRKSVIDDGRCYLCPCLGYPRQWRSEDIYQEINETIQIIEI

SEQ ID NO: 5253 - DNA, 1407 bp, Staphylococcus aureus
atggcaagaaaattgcatagagagttgaataacagacacatccaattaatagcaattgggggcgcaattggaactgggttattcctaggatcaggtcaaacaatatctttaactggtccatcactgttattcacatacatgattattggggttgtactattcgcttttatgcgcgcattaggcgaattgttgttgagcaatacaagatttaattcatttgttgatattgcaaatgaatatttaggcccttttggtggctttgtcattggctggacttactggttatgttggattgtatcaagtatgtcagacctaactgcgatgggacaatactttgcattttggtatccacaagtcccaaattggattaccgtgctatttattgttttaatcttgattagcttcaacttattaggtgccagattatttggtgaactggagttttggttctcgattattaaagttgtcacaattattgcgatggttatcgttggtcttgtattaatctttttctcatttaaaacacattatggacatgcatcattcacaaacttaatcagtcacggtggcatgttccctggtggaacatttggtttcttaatgtcattccaaattgctgtatattcattcattggtattgaacttataggtgtaactgctggtgaaacgaaagatcctgaaaaaaccttaccgaaagcaattaataatgtacctatccgtattttattattctatatcggtggtctattagtaattatgtcagtcataccttggaatgatatcgatccaaatagtagccctttcgttaaactctttacattaatcggcgtaccatttgcagcaggtgtcgttaactttgtcgtgctaactgccgcggcctctgctacaaatagtggtatctattcgaatagtcgtatcttattcggactgtcacaacaagggttaggtcctaaagttttaaataaaacgaatagtcatggcgtgccttatttatcaatgttagtttcatcaattgcattacttatagcagccttgttaaactacattttccctaatgcaattcaactattcatatacgttacaacgttatcaactgtgttgtttttagttgtttgggcaatgattattgtcgcttatctaatgtatttgaaaaagcatcctgaggcacataaaaacagtaaatttaagttgattggtggtaagcctattgcttacattattctagcgttcttcttctttgtattcattttattattctttagtgacgaaacaagagcagctatttatatttcgccattctggtttatatttttatttttcttttataaaaaatacaaaacgaatgctgaaaagctcgcgtatgaacaacgacaaaatgacagcggtcatttcagatatgacaatcaa

SEQ ID NO: 5254 - protein, 469 aa, Staphylococcus aureus
  MISC_FEATURE (1)..(469): amino acid ABC transporter
MARKLHRELNNRHIQLIAIGGAIGTGLFLGSGQTISLTGPSLLFTYMIIGVVLFAFMRALGELLLSNTRFNSFVDIANEYLGPFGGFVIGWTYWLCWIVSSMSDLTAMGQYFAFWYPQVPNWITVLFIVLILISFNLLGARLFGELEFWFSIIKVVTIIAMVIVGLVLIFFSFKTHYGHASFTNLISHGGMFPGGTFGFLMSFQIAVYSFIGIELIGVTAGETKDPEKTLPKAINNVPIRILLFYIGGLLVIMSVIPWNDIDPNSSPFVKLFTLIGVPFAAGVVNFVVLTAAASATNSGIYSNSRILFGLSQQGLGPKVLNKTNSHGVPYLSMLVSSIALLIAALLNYIFPNAIQLFIYVTTLSTVLFLVVWAMIIVAYLMYLKKHPEAHKNSKFKLIGGKPIAYIILAFFFFVFILLFFSDETRAAIYISPFWFIFLFFFYKKYKTNAEKLAYEQRQNDSGHFRYDNQ

SEQ ID NO: 5255 - DNA, 942 bp, Staphylococcus aureus
atgatagaaatcgaaaaacctagaattgagacaattgaaattagtgaagatgctaaattcggtaagttcgttgttgaaccactagaacgtggctacggtactacactaggaaactccttacgtcgtatcctactatcttcattaccaggtgcagccgttaagtatattgaaattgagggagttttacatgaattctcagcagtagacaatgtagttgaagatgtttctacaattattatgaacattaaacaattagcattgaaaatttactctgaagaagataaaactttagaaattgatgtacgtgatgaaggcgaagtaacagcaagcgacattacacatgatagtgatgttgaaattttaaacccagagcttaaaattgcaacagtatctaaaggtggtcacttaaaaattcgtctagttgctaacaagggtagaggttacgcattagcagaacaaaataatactagtgatttaccaattggtgtaatccctgttgattcattgtattcacctgttgaacgtgtgaactatactgttgaaaatacacgtgtaggtcaaagcagtgattttgataaattaacattggatgtttggactaatggttcaatcacaccacaagaatcagtttcattagcagcaaaaataatgactgaacacttgaatatcttcgttggtcttactgatgaagcgcaaaacgctgaaatcatgattgaaaaagaagaagatcaaaaagaaaaagtattagaaatgtctattgaagaattagacttatctgtacgttcatataactgcttaaaacgcgcaggaatcaattctgttcaagagttagctgacaaatctgaagctgacatgatgaaagtgcgtaatttaggtcgtaaatctttagaagaagttaaatacaaattagaagatttaggattaggattaagaaaagaagat

SEQ ID NO: 5256 - protein, 314 aa, Staphylococcus aureus
  MISC_FEATURE (1)..(314): DNA-directed RNA polymerase
MIEIEKPRIETIEISEDAKFGKFVVEPLERGYGTTLGNSLRRILLSSLPGAAVKYIEIEGVLHEFSAVDNVVEDVSTIIMNIKQLALKIYSEEDKTLEIDVRDEGEVTASDITHDSDVEILNPELKIATVSKGGHLKIRLVANKGRGYALAEQNNTSDLPIGVIPVDSLYSPVERVNYTVENTRVGQSSDFDKLTLDVWTNGSITPQESVSLAAKIMTEHLNIFVGLTDEAQNAEIMIEKEEDQKEKVLEMSIEELDLSVRSYNCLKRAGINSVQELADKSEADMMKVRNLGRKSLEEVKYKLEDLGLGLRKED

SEQ ID NO: 5257 - DNA, 2076 bp, Staphylococcus aureus
atggcactattagaagcatttttaatttttatttttgctgtgattattagttcggttatcaataatcgattcccacaaattcctactgcctttattcaaattgcattaggtgtcgttattttcattattccaatacaagttgatttccaattcaattctgaagtatttatgtttgccgttatcgcgccactactttttgtggaaggtacccacgtctctcgaacaaaattattagaatatcgtaaacctatactattaatgtcaatggcactagtgtttgcaactgtagtcggtgttggctattttatacattggatttggcctgccttaccaatgccagccgcttttgcaatagcagcaattttatgtcctactgatgcagtagcagtatctgctattacacgcggaaaattattacctaaaggttctatgacgattttagaaggtgaatctttactcaatgatgcagcaggtatcatttcatttaaaattgctgttactgcattagtaactggtaccttttcattattccaagctgttgaacaatttatcatttcaacaatactaggtgtacttattggtgcaattattggattcgttgtcgttagaatacgtatagacttaaccgctaataaaggtttaaaagataacaataccttaacttttattcaattattaactccttttgtcgtatactttttagcagaagaagttcatgcttcaggtatcattgcagttgtaatcgcaggtctaatccatggtttagaacgcgaccgtttaattagagcacaaacggaactacaaatgaattaccatcaaatttggaacacatttagttatgccttaaatggttttgtatttgttgtattaggttttatgattcctactgtagtcatagatattttccaaacagagcctgacaacttttcatttttaatagtgatcactatattaatcgctattgcaatttatgcatgtcgatttgtttgggtttatttctggtacaaagatttttatttcccgaaaaatatacaatcttatctagacgaggaacatgattcacatgaaacaccaccttctcgagtgcgttacgcatttattatgaccatgtgtggtattcacggtacaatttcactttcaatggcacttacattaccatttatcattacaaaaggacaagcattcgaataccgtaatgatttattgtttattgcatctttcatggtattaattagtttaatcttagcgcaaattgttttacctttaattacaccatctgccgaagatactacttttaaaggtatgacttatcaatctgccaaaattttcattgttcaaaaagtgatccagcattttaaaaacgaaagtaaaaaagacaaaaacgatacaaattatcgcccagtattaaaccaatactatggagaattgttatttttattaaattcagaacctgataatcaaaatacaaaagaactcaaacgtttagaagatattgcaaaagtaatcgaaacatctacacttgagcgtttaattgataaaggtaaggcaacatatcaggatattaataattaccgcaatattgtcgaattaacagagacacaccgtactgcatcatttgttgaaaaatttgcaaacttcttcaagatgttatggcttagacttaaagcgatgaagcactacaaagccttaaataaagaatctaagaagcaagaatttgaaaattcattcaaagatgttcaaaaaattatgcgtattgtgaatcacaatattattttacgcttaaaagaagaacaaaatagtacaaatgtacttgaggttagcttagtcattaatcattactatgatatgagtcgctcattaaagtggcgtgcacaacgtcgaaaagaacgtcaagaaaacagcaatcaaatcataccgcaagctatgttccataaccacaaattggaagcattgtacttacaacgtcatcttttagatgaattaattcgcaaaaataaaatcaacaatatcgttgcagctcaaattcgagaaaatatcaattacaacgaaattgtcttgtctttacagtccaaacat

SEQ ID NO: 5258 - protein, 692 aa, Staphylococcus aureus
  MISC_FEATURE (1)..(692): hypothetical protein
MALLEAFLIFIFAVIISSVINNRFPQIPTAFIQIALGVVIFIIPIQVDFQFNSEVFMFAVIAPLLFVEGTHVSRTKLLEYRKPILLMSMALVFATVVGVGYFIHWIWPALPMPAAFAIAAILCPTDAVAVSAITRGKLLPKGSMTILEGESLLNDAAGIISFKIAVTALVTGTFSLFQAVEQFIISTILGVLIGAIIGFVVVRIRIDLTANKGLKDNNTLTFIQLLTPFVVYFLAEEVHASGIIAVVIAGLIHGLERDRLIRAQTELQMNYHQIWNTFSYALNGFVFVVLGFMIPTVVIDIFQTEPDNFSFLIVITILIAIAIYACRFVWVYFWYKDFYFPKNIQSYLDEEHDSHETPPSRVRYAFIMTMCGIHGTISLSMALTLPFIITKGQAFEYRNDLLFIASFMVLISLILAQIVLPLITPSAEDTTFKGMTYQSAKIFIVQKVIQHFKNESKKDKNDTNYRPVLNQYYGELLFLLNSEPDNQNTKELKRLEDIAKVIETSTLERLIDKGKATYQDINNYRNIVELTETHRTASFVEKFANFFKMLWLRLKAMKHYKALNKESKKQEFENSFKDVQKIMRIVNHNIILRLKEEQNSTNVLEVSLVINHYYDMSRSLKWRAQRRKERQENSNQIIPQAMFHNHKLEALYLQRHLLDELIRKNKINNIVAAQIRENINYNEIVLSLQSKH

SEQ ID NO: 5259 - DNA, 99 bp, Staphylococcus aureus
atgttaacgtatgtacaattccatttaaacttaaaaaatagattctataatcaaatcggattgatgaaaggttatttacttttcatcaatctgattttt

SEQ ID NO: 5260 - protein, 33 aa, Staphylococcus aureus
MLTYVQFHLNLKNRFYNQIGLMKGYLLFINLIF

SEQ ID NO: 5261 - DNA, 1827 bp, Staphylococcus aureus
atgttcaatcaatttaaaagacttattatagggcaacctaaaaaaaacagagaactaaaagacgaaaagatatcgaagtttaaagggttagcgattctttcgtcggatgcattatcttcagtggcttacggtcccgaacaaatactgattacactatcagtagtgggtgcagttgcaacttggtatactttaccgattgcaggtgctgttctgatcttattagctgctttaattatgtcttataggcaaattatttatgcatatcctaaaggtggcggcgcgtatatggtgtccaagaccaatttaggagaaaaatggggattgcttgcaggaggctcattattagtcgattacatactgactgtcgctgttagtatatcatctggtgctgatgcatttgttgctgcattcccaagtttatatgggcataaagtactgattgcatgtttacttgtactttttattttaatattaaatttacgtggtttaactgaatctgccaccgtattatcctatccagtatatcttttcattatagggttagtgatattaatatttataggtactttccgtgtggcgacaggagatattcaaccacatatgcatgcatcagtaggaactgcggttcctggagtaacattattcttgctattaaaagcattttcatcaggggcttcatcgttaacgggtgttgaagctatttcaaatgcggtaaccaattttagagagccaagtgctaaaaatgctgtgaaaacgttaattgctatgggttcaattttagcgtttttattagttggtatcgttggtttagcatatgtttatggaattttgccacaaacggaaacgacagttttatcacaattagctatgcaaatatttggtgataatgctgccttctattttgtacaggcaacgaccgtgatgattttggtattagcagccaacactggatttacagcttttccgatgttagcggcttcaatgtctaaagataaatatatgcctagaatgtttactgttagaggtgatcgcttaggctactctaactcgattattattttaggtgtattagccattattttaattattgtatttgatggtatgactgaagatttaattccattgtatgcggttggtgtatttattccatttacactagcacaattcggtatggttattaaatggattcatgaacgtcctaagaattggttaagtaagttgtctgtgaacttacttggtggtatcgtgacatttattgtttttatgattttactcataactaaatttagccaagtatggccgatacttattttcttgccgttcgtggtgattttcttcttgaaaattaacaaacattatcgagatatcgcagaacaattacgttctgacattgatgttcttaatgtggacgtggtagatcgtaatttagcaattgtgccgataacaagtattacaacagcagttgataagtctatttattacgcacaaatgcttgcgaataatgatgtcatagcagtacatgtatcatttggagatgaagatgaaaaagcattccaagagaaatggaaacgtcatttcccagatgtaagattagttattttacattcggaatatcgcagtattatacgaccaatttcacgttttatcgataagattaatcgtaaagccaacgatcaaaactatatgattacagtagtgataccagaatttattactaagaaacgttggcataatttattacacaatcaaactagtttgcgtatgaaattgtatttaatttatcaaaagaatgttaacgtatgtacaattccatttaaacttaaaaaa

SEQ ID NO: 5262 - protein, 609 aa, Staphylococcus aureus
  MISC_FEATURE (1)..(609): conserved hypothetical
MFNQFKRLIIGQPKKNRELKDEKISKFKGLAILSSDALSSVAYGPEQILITLSVVGAVATWYTLPIAGAVLILLAALIMSYRQIIYAYPKGGGAYMVSKTNLGEKWGLLAGGSLLVDYILTVAVSISSGADAFVAAFPSLYGHKVLIACLLVLFILILNLRGLTESATVLSYPVYLFIIGLVILIFIGTFRVATGDIQPHMHASVGTAVPGVTLFLLLKAFSSGASSLTGVEAISNAVTNFREPSAKNAVKTLIAMGSILAFLLVGIVGLAYVYGILPQTETTVLSQLAMQIFGDNAAFYFVQATTVMILVLAANTGFTAFPMLAASMSKDKYMPRMFTVRGDRLGYSNSIIILGVLAIILIIVFDGMTEDLIPLYAVGVFIPFTLAQFGMVIKWIHERPKNWLSKLSVNLLGGIVTFIVFMILLITKFSQVWPILIFLPFVVIFFLKINKHYRDIAEQLRSDIDVLNVDVVDRNLAIVPITSITTAVDKSIYYAQMLANNDVIAVHVSFGDEDEKAFQEKWKRHFPDVRLVILHSEYRSIIRPISRFIDKINRKANDQNYMITVVIPEFITKKRWHNLLHNQTSLRMKLYLIYQKNVNVCTIPFKLKK

SEQ ID NO: 5263 - DNA, 102 bp, Staphylococcus aureus
gtgcctaatgagatttattttattataccagttctattgaataaattaattaaagaggtatatttaccattatttttgacaccttatatgttaataggtgta

SEQ ID NO: 5264 - protein, 34 aa, Staphylococcus aureus
VPNEIYFIIPVLLNKLIKEVYLPLFLTPYMLIGV

SEQ ID NO: 5265 - DNA, 171 bp, Staphylococcus aureus
gtgattagtgctaatttaatttctattggtagccaagtcagtacaaaagaccaattattgctaccgagaatgagatatggtaatgcatataatatgagcgctaaagcgatacatatacataatgataaccaactcaatacagcaatccgttttgatctacgcaaaagaatt

SEQ ID NO: 5266 - protein, 57 aa, Staphylococcus aureus
VISANLISIGSQVSTKDQLLLPRMRYGNAYNMSAKAIHIHNDNQLNTAIRFDLRKRI

SEQ ID NO: 5267 - DNA, 1494 bp, Staphylococcus aureus
atgactactaaaaaactgtattttctatccatttctattatcattttagtcgccatttcaattgctatatatataacattaaatagcaatacgaagacacggttaaccaatgattcgcaacaacaaatagatacaattatcgagcatgatttacaaaagggacacattcctggagcatcaattttaatagtaaaaaatggcaaagtttttttaaataaaggttatggttatcaagatgttgataaaaaagtcaaagcttctcccacaacaaagtatgaaattgcttctaatacgaaagctttcacaggtcttgcaattttaaaattagctcaagaaggtcgattaaacttaaatgatgccgtatccaaacatgtgcctcattttaaaatgaactataatggtcaaaatgaaactattacgattaagcaacttttggctcaaacaagtggtatacctagtgatattacaagcgaagattctgtgacaagcaaaaataatcgtttaaatgatgtaacccatgcaattatgggtgatgaattacatcataagcccggagaagaatttgaatactcaaatatgaactatgatttattaggtttaattatccaaaacgttacgaagcaatcctatacaaaatatattacaaattcatggctcaagcctttgcatatgacacatacatcattcaaacaaaccaattacaaatcaaaacatgatgctattggctatgaattacaaggttcgacacctgtcgtctctaaacctgaatttaacctttgggatacaccatcagcatatatgatgacatcaactgaagatttggaacattggataaaattccaacttaatccacctgataaatacaaatcattagttcaacaatcacataaaaatttatcttcaacaattggtgaacctaatgccaatgcatatgcttccggctggtttaccaataatgatgaacatttagtgtttcattcaggaacgctagataacttttcatcatttattttactaaatccaaaacaaaattatggaattgttgtacttgcaaatctaaattcggaatatgtacccaaattagttgagcatcttaatacacaaattgtaaatcacaagcgatattcgacggttgcgtctatgctcaatcaatataaagatcaatttaatattgttaccgttttgatgacaacacttattttattagcatttatattctcagcttatcgtgcttggcaaatgcgccatggtcaaattcttttgcgtagatcaaaacggattgctgtattgagttggttatcattatgtatatgtatcgctttagcgctcatattatatgcattaccatatctcattctcggtagcaataattggtcttttgtactgacttggctaccaatagaaattaaattagcactaatcacaacattaattgcattattcagtacattaattgtaattctgttattccttcatacaaagataacgaagaca

SEQ ID NO: 5268 - protein, 498 aa, Staphylococcus aureus
  MISC_FEATURE (1)..(498): hypothetical protein
MTTKKLYFLSISIIILVAISIAIYITLNSNTKTRLTNDSQQQIDTIIEHDLQKGHIPGASILIVKNGKVFLNKGYGYQDVDKKVKASPTTKYEIASNTKAFTGLAILKLAQEGRLNLNDAVSKHVPHFKMNYNGQNETITIKQLLAQTSGIPSDITSEDSVTSKNNRLNDVTHAIMGDELHHKPGEEFEYSNMNYDLLGLIIQNVTKQSYTKYITNSWLKPLHMTHTSFKQTNYKSKHDAIGYELQGSTPVVSKPEFNLWDTPSAYMMTSTEDLEHWIKFQLNPPDKYKSLVQQSHKNLSSTIGEPNANAYASGWFTNNDEHLVFHSGTLDNFSSFILLNPKQNYGIVVLANLNSEYVPKLVEHLNTQIVNHKRYSTVASMLNQYKDQFNIVTVLMTTLILLAFIFSAYRAWQMRHGQILLRRSKRIAVLSWLSLCICIALALILYALPYLILGSNNWSFVLTWLPIEIKLALITTLIALFSTLIVILLFLHTKITKT

SEQ ID NO: 5269 - DNA, 858 bp, Staphylococcus aureus
gtgtttataatgagtaaaatttttgtaactggtgcaacgggccttattggcattaaattagttcaaagactaaaagaagaggggcatgaggttgctggttttactacatctgagaatggtcaacaaaagctagctgctgttaatgtaaaagcatatattggtgatatattaaaagctgatactattgatcaagcgttagcagattttaaaccagaaatcattatcaatcaaattacggatttaaaaaatgttgatatggcagcaaatacgaaagtacgtattgaaggttctaaaaacctaattgatgcggcgaaaaagcatgacgttaagaaagtaattgcccaaagtattgcctttatgtatgaacctggcgaaggattagcaaatgaggaaacttcacttgattttaactcaactggcgatagaaaagtaacggttgatggtgtggttggtttagaagaagaaacggctcgtatggatgaatacgttgttttacgttttggctggttatatggcccaggtacttggtacggaaaagatggcatgatttataatcaatttatggatggtcaagtgacactttcagatggcgtaacatcatttgtgcatcttgatgatgcagttgaaacatctattcaagctattcattttgaaaatggtatctataatgtagcagatgatgcacctgttaaaggttctgaatttgcagaatggtataaagaacaacttggtgttgaaccaaatattgatattcaacctgcgcaaccatttgaacgtggcgtaagcaatgagaagtttaaagcgcaaggtggtactctgatttatcaaacttggaaagatggcatgaatccaattaaa

SEQ ID NO: 5270 - protein, 286 aa, Staphylococcus aureus
  MISC_FEATURE (1)..(286): hypothetical protein
VFIMSKIFVTGATGLIGIKLVQRLKEEGHEVAGFTTSENGQQKLAAVNVKAYIGDILKADTIDQALADFKPEIIINQITDLKNVDMAANTKVRIEGSKNLIDAAKKHDVKKVIAQSIAFMYEPGEGLANEETSLDFNSTGDRKVTVDGVVGLEEETARMDEYVVLRFGWLYGPGTWYGKDGMIYNQFMDGQVTLSDGVTSFVHLDDAVETSIQAIHFENGIYNVADDAPVKGSEFAEWYKEQLGVEPNIDIQPAQPFERGVSNEKFKAQGGTLIYQTWKDGMNPIK

SEQ ID NO: 5271 - DNA, 195 bp, Staphylococcus aureus
atgacaaatctgaattatgacgaagatcaatcaagaaaaacagcaccaagatcatttcaatttgaaagtaccttactgctgttctttatttattacatttcaatcttaataatgaccgtaatatcacgtgattgtcatttccttgtaatcatacctaaaacaccaattaatcctgtgcgtgtcgctgactttctt

SEQ ID NO: 5272 - protein, 65 aa, Staphylococcus aureus
MTNLNYDEDQSRKTAPRSFQFESTLLLFFIYYISILIMTVISRDCHFLVIIPKTPINPVRVADFL

SEQ ID NO: 5273 - DNA, 933 bp, Staphylococcus aureus
atgaaaattgcaattgctggatcgggtgcattaggtagtggctttggtgccaaactatttcaagcaggatatgatgtcacacttattgacggatatacatctcatgttgaagcggttaagcaacatggattaaatataacgattaatggagaggcattcgagttaaacattccgatgtatcattttaatgatcaaccggacgaaagcatttacgatgttgtctttctatttccaaagtctatgcaattaaaagaagtgatggaagatatgaagccacatattgataatgaaacgatcgtcgtatgtacgatgaatggtctgaagcatgaagaagtcattgcgcagtatgttgctcaatcacaaattgtcagaggtgttacgacttggacggcaggtcttgaaagccctggacacagtcatttacttggtagtggaccagttgaaataggtgaactagtggatgaaggtaaagaaaatgttataaaagttgctgatttacttaacgaagcggaattgaatggtgtcattagtaaagatttataccaatcgatttggaaaaagatttgtgttaatggtacggcaaatgcattaagcacagtgttggagtgtaatatggcatcgctgaatgaaagtagttatgcgaagtgtttgatttataaattaacgcaagaaatagtgcatgtagcgacgattgataatgttcatttaaatgttgatgaagtatttgaatatttagttgatttaaatgaaaaagttggtgcgcattatccatccatgtatcaagatttaattgttaataatagaaaaactgaaattgattatattaatggcgcagttgcaacattaggtaaacaacgtcatattgaagcgccagtcaatcgctttattactgatttaattcatactaaagaaagtcagcgacacgcacaggat

SEQ ID NO: 5274 - protein, 311 aa, Staphylococcus aureus
  MISC_FEATURE (1)..(311): hypothetical protein
MKIAIAGSGALGSGFGAKLFQAGYDVTLIDGYTSHVEAVKQHGLNITINGEAFELNIPMYHFNDQPDESIYDVVFLFPKSMQLKEVMEDMKPHIDNETIVVCTMNGLKHEEVIAQYVAQSQIVRGVTTWTAGLESPGHSHLLGSGPVEIGELVDEGKENVIKVADLLNEAELNGVISKDLYQSIWKKICVNGTANALSTVLECNMASLNESSYAKCLIYKLTQEIVHVATIDNVHLNVDEVFEYLVDLNEKVGAHYPSMYQDLIVNNRKTEIDYINGAVATLGKQRHIEAPVNRFITDLIHTKESQRHAQD

SEQ ID NO: 5275 - DNA, 1398 bp, Staphylococcus aureus
atggacacatcaaaacaatttagaggtgacaaccgattgcttttgggtatcgttttaggggttattaccttttggctattcgcgcagtcacttgttaatcttgttgtcccattacaatcaacatatagtagtgacgttggaacgataaatatcgctgttagcttatctgccttatttgctggtttgtttatcgtaggtgctggtgatgttgctgataaatttggtcgcgtcaaaattacttatgtaggattgatattaaatgttgtaggttcattactcatcatcattacacctttgccagcatttttaattataggtagaataattcaaggtttgtctgcagcatgtattatgccatcaacacttgctattattaacgaatattatattggtacaagaagacaacgtgccttaagctattggtctattggttcttggggtggtagtggtatttgtacgttgtttggtggcttaatggctacatatataggttggcgttcaatatttgttgtttcaattctattaacattattagcaatgtacttaatcaaacatgcacctgagactaaagcagaaccaatcaaaggtatgaaagcagaagctaaaaagtttgacgttattggtttagtcattttagtagtgacgatgttaagtttaaatgtaatcatcacacagacgtctcattttggtttagtttcaccgttaattctaggtttaattgttgtgtttatctgttcattagttggttttgtatattacgaaaataaaataaagcatccacttgttgatttttcaatttttaaaaatagaggatacagtggtgcaactatttcaaacttcttattaaatggtgtagcaggtggtgcacttatcgttattaacacgtattatcaacaacaattaggatttaattcttcgcaaacgggttatatttcattaacgtatttaataacagtgttgtcaatgattcgtgtaggtgaaaagattttatctcaacatggtccgaagcgcccactattactaggaagtggctttacagtgattgggttaatcttattgtcgttaacatttttaccagaagtgtggtatatcatatctagtatagttggatatttattgtttggtactggtttaggattatatgctacaccatcaactgatacagcagttgctagtgcgccagatgataagtcgggtgttgcttcaggtgtgtataaaatggcgtcatcattaggaaatgcatttggagtagcagtatctggtacggtttatactgtgttagcagctaatttaaatttgaacttaggtggtttcacaggtatgatgtttaatgccttgctagcaattgttgcatttttagtcattttactattagttcctaaaaatcaaacgaatttg

SEQ ID NO: 5276 - protein, 466 aa, Staphylococcus aureus
  MISC_FEATURE (1)..(466): hypothetical protein
MDTSKQFRGDNRLLLGIVLGVITFWLFAQSLVNLVVPLQSTYSSDVGTINIAVSLSALFAGLFIVGAGDVADKFGRVKITYVGLILNVVGSLLIIITPLPAFLIIGRIIQGLSAACIMPSTLAIINEYYIGTRRQRALSYWSIGSWGGSGICTLFGGLMATYIGWRSIFVVSILLTLLAMYLIKHAPETKAEPIKGMKAEAKKFDVIGLVILVVTMLSLNVIITQTSHFGLVSPLILGLIVVFICSLVGFVYYENKIKHPLVDFSIFKNRGYSGATISNFLLNGVAGGALIVINTYYQQQLGFNSSQTGYISLTYLITVLSMIRVGEKILSQHGPKRPLLLGSGFTVIGLILLSLTFLPEVWYIISSIVGYLLFGTGLGLYATPSTDTAVASAPDDKSGVASGVYKMASSLGNAFGVAVSGTVYTVLAANLNLNLGGFTGMMFNALLAIVAFLVILLLVPKNQTNL

SEQ ID NO: 5277 - DNA, 387 bp, Staphylococcus aureus
atggcacgtaaacaagtatctcgtaaacgtagagtgaaaaagaatattgaaaatggtgtagcacacatccgttcaacattcaacaacactattgtaactatcactgatgagttcggtaatgctttatcatggtcatcagctggtgcattaggattcaaaggatctaaaaaatcaacaccatttgcagcacaaatggcttctgaaactgcatctaaatcagctatggagcatggtttaaaaacagttgaagtaacagttaaaggacctggtccaggtcgtgaatcagctattcgtgcattacaatctgcaggtttagaagtaactgcgatcagagacgttactccagtacctcataacggttgtcgtccaccaaaacgtcgtcgtgta

SEQ ID NO: 5278 - protein, 129 aa, Staphylococcus aureus
  MISC_FEATURE (1)..(129): 30S ribosomal protein S11
MARKQVSRKRRVKKNIENGVAHIRSTFNNTIVTITDEFGNALSWSSAGALGFKGSKKSTPFAAQMASETASKSAMEHGLKTVEVTVKGPGPGRESAIRALQSAGLEVTAIRDVTPVPHNGCRPPKRRRV

SEQ ID NO: 5279 - DNA, 693 bp, Staphylococcus aureus
atggaaggtaatttattacagcaattattcaattattatgttacgaactttggttatctatgggatttatttttcaaacacttattaatgtctgtctatggtgtgctgtttgcagctttaattggtattccattgggaatcttgcttgcaagatacacaaaactttctggatttgtaattacaattgcaaatataattcaaacagttccagtcattgcaatgttagctattttaatgttagtcatgggcttaggttcagaaacagtagttttaacagtgtttttatatgcgttacttccaattataaaaaacacttatactggtatagctagtgttgatgcgaatattaaggatgctggcaaaggtatgggaatgacacgcaatcaagtgctacgaatgattgaattaccgttatctgtttcggttattatcggtggcattcgtattgccttggttgttgcgataggtgttgttgccgttggatcatttataggagcacctacgcttggtgacattgtgattcgtggtacaaatgcgacggatggcacaacgtttattttagcaggtgcgattccgattgctatcattgcaatcgtcattgatgtactattaagatttttagaaaaacgattagacccaacaacacgacatcgtaaaaatcaatctaatcatcggccgcaaagtattaatatg

SEQ ID NO: 5280 - protein, 231 aa, Staphylococcus aureus
  MISC_FEATURE (1)..(231): probable glycine
MEGNLLQQLFNYYVTNFGYLWDLFFKHLLMSVYGVLFAALIGIPLGILLARYTKLSGFVITIANIIQTVPVIAMLAILMLVMGLGSETVVLTVFLYALLPIIKNTYTGIASVDANIKDAGKGMGMTRNQVLRMIELPLSVSVIIGGIRIALVVAIGVVAVGSFIGAPTLGDIVIRGTNATDGTTFILAGAIPIAIIAIVIDVLLRFLEKRLDPTTRHRKNQSNHRPQSINM

SEQ ID NO: 5281 - DNA, 939 bp, Staphylococcus aureus
atgaagaaaattaaatatatacttgtcgtgtttgtcttatcgcttaccgtattatctggatgtagtttgcccggactaggtagtaagagcacgaaaaatgatgtcaaaattacagcattatcaacaagcgaatcgcaaattatttcacatatgttacggttgttaatagagcatgatacacacggtaagataaagccaacattagtaaataatttagggtcaagtacgattcaacataatgccttaattaatggggatgctaatatatcaggtgttagatataatggcacagatttaacgggagctttgaaggaagcaccaattaaaaatcctaagaaagcaatgatagcaacacaacaaggatttaaaaagaaatttgatcaaacgttttttgattcgtatggttttgcgaatacgtatgcattcatggtaacgaaggaaaccgctaaaaaatatcatttagagacagtttcagatttagcaaagcatagtaaagatttacgtttaggtatggatagttcatggatgaatcgtaaaggcgatggctatgaaggatttaaaaaagagtatggttttgactttggtacagtgagaccaatgcaaataggtctagtctacgacgcattaaactcagagaagttagacgttgcattaggttattctacagatggtcgaattgcggcgtatgatttgaaagtacttaaagatgataaacaatttttcccaccttatgctgcgagtgctgttgcaacaaatgaattattacggcaacacccagaacttaaaacgacgattaataagttgacaggaaagatttcgacttcagagatgcaacgcttgaattatgaagcggatggtaaaggtaaagaacctgctgtcgtcgcagaagaatttttgaaaaaacaccactattttgataaacagaaaggtggtcataag

SEQ ID NO: 5282 - protein, 313 aa, Staphylococcus aureus
  MISC_FEATURE (1)..(313): glycine
MKKIKYILVVFVLSLTVLSGCSLPGLGSKSTKNDVKITALSTSESQIISHMLRLLIEHDTHGKIKPTLVNNLGSSTIQHNALINGDANISGVRYNGTDLTGALKEAPIKNPKKAMIATQQGFKKKFDQTFFDSYGFANTYAFMVTKETAKKYHLETVSDLAKHSKDLRLGMDSSWMNRKGDGYEGFKKEYGFDFGTVRPMQIGLVYDALNSEKLDVALGYSTDGRIAAYDLKVLKDDKQFFPPYAASAVATNELLRQHPELKTTINKLTGKISTSEMQRLNYEADGKGKEPAVVAEEFLKKHHYFDKQKGGHK

SEQ ID NO: 5283 - DNA, 633 bp, Staphylococcus aureus
atgattgagttcctacatgaacatggtggacagttgatgtcgaaaacactggaacatttctatatttctatagtggcattattacttgccatcattgttgcagtacctataggcattttattatcaaaaacaaagcgaactgccaatattgtattaactgtggcaggtgtcttacaaactattccaacactagctgtacttgctattatgataccgatttttggtgttggtaaaacgcctgcaattgtagcgctatttatttatgtattattacctattttaaataacacggtactcggtgttcaaaatattgatagcaacattaaagaagctggaaaaagtatgggaatgacacaatttcaattgatgaaggatgttgaattgccgttagcattgccgcttatcattggtggcattcgtttgtcatctgtgtatgtaattagttgggctacacttgcaagttatgtaggtgcgggtggattaggtgatttcattttcaatggtttaaatttatatgatccactgatgattgtaactgcaacggtactcgttactgcactagcattaggtgttgatgccttattagctttagttgaaaaatgggtagttcccaaaggcttaaaagtatctgga

SEQ ID NO: 5284 - protein, 211 aa, Staphylococcus aureus
  MISC_FEATURE (1)..(211): probable glycine
MIEFLHEHGGQLMSKTLEHFYISIVALLLAIIVAVPIGILLSKTKRTANIVLTVAGVLQTIPTLAVLAIMIPIFGVGKTPAIVALFIYVLLPILNNTVLGVQNIDSNIKEAGKSMGMTQFQLMKDVELPLALPLIIGGIRLSSVYVISWATLASYVGAGGLGDFIFNGLNLYDPLMIVTATVLVTALALGVDALLALVEKWVVPKGLKVSG

SEQ ID NO: 5285 - DNA, 1269 bp, Staphylococcus aureus
atgcgtatcattcgtcatattttttatgaggaaggagaaatgattatgttaagtattaagcatttaacgaaaatttattctggtaataaaaaggcagtagatgacatctctttagatattcaatctggggaatttatcgcatttattggaaccagtggaagtggcaaaacgactgctttaagaatgataaaccgtatgattgaagcgacagaaggacaaattgaaattgatggtaaagatgttcggagtatgaatcctgtcgaattgcgtagaaatattggctatgttattcaacaaattggcttaatgcctcatatgacgattaaagagaatattgtgttggtacccaaattgttgaaatggactaaagaggaaaaggataaacgtgcaaaggaattaattaaacttgtggatttaccggagtcatttttagagcgttatccagcagaactatcaggtgggcaacaacaacgtatcggtgttgtaagagcacttgcggccgaacaagatattattttaatggatgaaccttttggtgcattggatcctattacgagagatacgttacaagatttagttaaaacgttacaacgaaaattaggcaagacgtttatctttgtaacacatgatatggatgaagcgattaaattagcagacaaaatttgtattatgtcagaaggtaaggtggtgcaatttgatacgccagacaatattttaagacatcccgcaaatgattttgtacgtgattttataggacaaaatagactgattcaagaccgtcccaatgacaagactgtagaaggtgtaatgattaaaccaatcacgatacaagcagaagcaacactgaatgacgccgttcatattatgagacaaaaacgtgttgatactatttttgtagtagatagtaataaccatttactaggtttcttagacattgaagatataaatcagggtatacgtggacacaaaagtttacgagacaccatgcaacaacatatttataccgttcaaattgattctaaattacaagattctgtacgtacgattttaaaaagaaacgttaggaatgtacctgtcgtagatgatcaacagcgtttagtaggactgattacgcgtgccaatgttgttgatattgtatatgacacgatttggggcgatagtgaggatacagtgcaaacagaacatgtgggggaagacactgcgtcctcaaaagtgcatgagcaacacactactaatgtcaaagtacgtgacataggagatgataaatca

SEQ ID NO: 5286 - protein, 423 aa, Staphylococcus aureus
  MISC_FEATURE (1)..(423): glycine
MRIIRHIFYEEGEMIMLSIKHLTKIYSGNKKAVDDISLDIQSGEFIAFIGTSGSGKTTALRMINRMIEATEGQIEIDGKDVRSMNPVELRRNIGYVIQQIGLMPHMTIKENIVLVPKLLKWTKEEKDKRAKELIKLVDLPESFLERYPAELSGGQQQRIGVVRALAAEQDIILMDEPFGALDPITRDTLQDLVKTLQRKLGKTFIFVTHDMDEAIKLADKICIMSEGKVVQFDTPDNILRHPANDFVRDFIGQNRLIQDRPNDKTVEGVMIKPITIQAEATLNDAVHIMRQKRVDTIFVVDSNNHLLGFLDIEDINQGIRGHKSLRDTMQQHIYTVQIDSKLQDSVRTILKRNVRNVPVVDDQQRLVGLITRANVVDIVYDTIWGDSEDTVQTEHVGEDTASSKVHEQHTTNVKVRDIGDDKS

SEQ ID NO: 5287 - DNA, 624 bp, Staphylococcus aureus
ttgaaaaacaaaatggaagtgatgactatgagtgagaaacaatcaaatgaacaagttgaagcatttttaaataaagagagtcaatggcaagaagaatataaatatttgagagcgttaatctttaatgaaacagaattagaggaagcgtataaatggatgcatccttgttacacgttgaataataaaaatgtagtacttatccatggcttcaaaaattatgttgcactattatttcataaaggtgccattttggaggataaatatcatacactcattcaacagactgaaaaggtgcaagcagctcgtcagttacgatttgaaaatttaacagagattcaagcacgtaccgaagaaattaaatattatctagccgaagcaattaaagctgaaaaagctggtaaaaaagttgaaatgaagaaaacagaggaatatgttattcctaaagagttagaagctaagttcgaagaaatgccacagttagagtcttcattttataaattaacgccaggcagacaacatcaatatatatatcatattggacaagctaaacgcagtgaaacaagacaaaagcgtgttgaaaagtatattaaccaaatactagaaggtaaagggatgcatgataag

SEQ ID NO: 5288 - protein, 208 aa, Staphylococcus aureus
  MISC_FEATURE (1)..(208): conserved hypothetical
LKNKMEVMTMSEKQSNEQVEAFLNKESQWQEEYKYLRALIFNETELEEAYKWMHPCYTLNNKNVVLIHGFKNYVALLFHKGAILEDKYHTLIQQTEKVQAARQLRFENLTEIQARTEEIKYYLAEAIKAEKAGKKVEMKKTEEYVIPKELEAKFEEMPQLESSFYKLTPGRQHQYIYHIGQAKRSETRQKRVEKYINQILEGKGMHDK

SEQ ID NO: 5289 - DNA, 1683 bp, Staphylococcus aureus
ttgtcgcatattattttttgtatttttggcaataacgaaggagtatttatgaataaagacaagcaattgcacaacgacaaaatcaatctatcccaattagtcttattagggttaggctctttaataggatctggttggctatttggtgcgtgggaagcatcatcaatagctggaccagcagcaatcatatcatgggttcttggattcctagtcattggaaccattgcctataactacattgaaatcggcacaatgtttcctcaatcaggtggcatgagtaactatgcccagtatacacatggctcattattaggctttattgctgcttgggcgaattgggtgtctttggtgacaataatacctatcgaagctgtgtcagctgttcaatatatgagttcttggccgtggcattgggcgaaaccaatgagatatttaatggaaaatggctctattagcacatacggattgctagctgtatatctcatcattgttattttttcattattaaactattggtccgtaaaacttttaacatcatttacgagtttaatttctgtatttaaattaggcgtacccatgttaaccatcatcatgttgatgctatcaggattcgacacttcaaattacggccattcggcaagcacatttatgccttacggaagtgcaccgatttttgctgcaacaacagcatcagggattattttttcattcaattcattccagacaattattaatatgggttcagaaattaaaaatcctgaaaaaaatatcgcaagaggcatcgctatctcactgtcaatcagtgcagtgttgtacatcattttacaaagtacgtttatcacttctatgcctcaatcaatgttacaacatagtggatggaatggcatcaacttcaattcaccatttgctgatttagctatcttattaggaattaattggctcgcaattttactatacattgaagcttttgtatcaccattcggtactggcgtgtcatttgtcgccgttacaggtcgagttttaccagcaatggagaaaaatggacatatccctaaatttcttgggaaaatgaatgaaaaatatcatatcccacgtgtagcaatcatctttaatgccatcattagtatgattatggttacattatttagagattggggtacgctagcagcagttatttctactgcaactttagtagcctatttaactggcccaacgacagtgattgcattaagaaaaatgggaccaacaatgactcgtccatttagagcaaaaattttaaaagtaatggcaccattatcatttgtattagcttcattagctatatattgggcaatgtggccaacaacggctgaagttattttaatcattatacttggattaccaatctacttcttctatgaatatcgtatgaattggcgtaatacaaagaaacaaattggtggtagcttatggattattgtatatttaatcgtgctatcaatactgtcatttataggaagcaaagaatttaaaggcttaaatatgattcactatccatttgactttatcgttattattattgtggcacttatcttctattacatcggtacaacgagttcatttgaaagcgtctatttccgtcgcgcaacacgaatcaatacgaagatgcgtgagtcactaaataatgaatcaaagtcatctcat

SEQ ID NO: 5290 - protein, 561 aa, Staphylococcus aureus
  MISC_FEATURE (1)..(561): hypothetical protein
LSHIIFCIFGNNEGVFMNKDKQLHNDKINLSQLVLLGLGSLIGSGWLFGAWEASSIAGPAAIISWVLGFLVIGTIAYNYIEIGTMFPQSGGMSNYAQYTHGSLLGFIAAWANWVSLVTIIPIEAVSAVQYMSSWPWHWAKPMRYLMENGSISTYGLLAVYLIIVIFSLLNYWSVKLLTSFTSLISVFKLGVPMLTIIMLMLSGFDTSNYGHSASTFMPYGSAPIFAATTASGIIFSFNSFQTIINMGSEIKNPEKNIARGIAISLSISAVLYIILQSTFITSMPQSMLQHSGWNGINFNSPFADLAILLGINWLAILLYIEAFVSPFGTGVSFVAVTGRVLPAMEKNGHIPKFLGKMNEKYHIPRVAIIFNAIISMIMVTLFRDWGTLAAVISTATLVAYLTGPTTVIALRKMGPTMTRPFRAKILKVMAPLSFVLASLAIYWAMWPTTAEVILIIILGLPIYFFYEYRMNWRNTKKQIGGSLWIIVYLIVLSILSFIGSKEFKGLNMIHYPFDFIVIIIVALIFYYIGTTSSFESVYFRRATRINTKMRESLNNESKSSH

SEQ ID NO: 5291 - DNA, 1350 bp, Staphylococcus aureus
atgaagattaatactacaggtggtcaaattcatggtattacacaagatggtttagatatcttcttaggcattccttatgcagaaccaccagttcatgacaatcgctttaaacattctacgttaaaaacacaatggtcagagccaattgatgcaactgaaatacaacccatcccaccgcaaccagacaacaaattagaagattttttctcctcacaatctacaacttttactgaacatgaagactgtttatatctaaatatttggaaacaacataatgatcagacgaagaaacctgtcatcatttatttttatggtggtagttttgaaaatggtcatggtacagccgaactctatcaaccggcacatttagtacaaaataacgacattatcgttattacatgcaattatcgtttaggcgcattaggatatttagactggtcatattttaataaagattttcattccaataatggcctttcagatcaaatcaatgtcataaaatgggtgcatcaatttattgaatccttcggtggcgacgctaataacattactttaatgggtcagtctgcaggcagtatgagcattttgactttacttaaaatacctgacattgagccatacttccataaagtcgttctactaagtggcgcactacgattagacacccttgagagtgcacgcaataaagcacaacatttccaaaaaatgatgctcgattatttagatacagatgatgttacatcattatcgacaaatgatattcttatgctgatggcgaagctaaaacaatctcgaggaccttctaaagggcttgatttaatatatgcgcctattaaaacagattatatacaaaataattatccaacaacgaaaccaatttttgcatgttatacaaaagatgaaggcgatatttatattactagtgaacagaaaaaattatcgccgcaacgctttatcgacattatggaattaaatgatattcctttaaaatacgaagatgttcagacggcgaagcaacaatctttagcgattacacattgttatttcaaacagccgatgaagcaatttttacaacaactcaatatacaagattcaaacgcacaactatggcttgctgaatttgcatggcatgatacttctagcgcacactatcgcagtgcttaccatattctagatatggtattttggttcggaaacttacaaatattagcagcacatcaatatccaacaactgctcaccttaaatttttaagtcgacaaatgcaaaatgatttagctaattttgctaaaagcggtaaaatgccttggccgatgtatcataatgaacgtcgctattatcgcacatatcaa

SEQ ID NO: 5292 - protein, 450 aa, Staphylococcus aureus
  MISC_FEATURE (1)..(450): hypothetical protein
MKINTTGGQIHGITQDGLDIFLGIPYAEPPVHDNRFKHSTLKTQWSEPIDATEIQPIPPQPDNKLEDFFSSQSTTFTEHEDCLYLNIWKQHNDQTKKPVIIYFYGGSFENGHGTAELYQPAHLVQNNDIIVITCNYRLGALGYLDWSYFNKDFHSNNGLSDQINVIKWVHQFIESFGGDANNITLMGQSAGSMSILTLLKIPDIEPYFHKVVLLSGALRLDTLESARNKAQHFQKMMLDYLDTDDVTSLSTNDILMLMAKLKQSRGPSKGLDLIYAPIKTDYIQNNYPTTKPIFACYTKDEGDIYITSEQKKLSPQRFIDIMELNDIPLKYEDVQTAKQQSLAITHCYFKQPMKQFLQQLNIQDSNAQLWLAEFAWHDTSSAHYRSAYHILDMVFWFGNLQILAAHQYPTTAHLKFLSRQMQNDLANFAKSGKMPWPMYHNERRYYRTYQ

SEQ ID NO: 5293 - DNA, 1206 bp, Staphylococcus aureus
ttgtttgaaaggagttttaaattgtcaatcatgcgactatttacattcattttaagtatttttatcgtaggaatggttgaaatgatggttgcaggaattatgaacttgatgagtcaggacttacatgtatcagaagctgtcgttggtcaattagtgacaatgtacgctttaacatttgcgatatgtggacctattctggttaaattaacgaaccgtttttcatcaaggcctgtattattatggacattacttatatttatcattggtaatggcattattgctgtagcgccaaatttttcaatattagtagttggtagaattatctcatctgcagcagcagcactaattatcgtaaaagtattagctattacagcgatgttatcagcacctaaaaatcgtggtaaaatgattggacttgtctatacagggtttagtggtgctaatgtttttggtgtaccaattggaacggttatcggcgatttagtaggttggcgctatacatttctattcttaattattgtgagtattattgttggcttcttgatgatgatctatttaccgaaggatcaggaaatacaacgaggccctgtgaatcatgagacaccatctcatgaaaatcatgttacttcgaaaatattaagacctgctgaagtagcaaaatatttaattattacgtttttagtattgattgcaaactcagtgacattcgtctttataaatccacttattttatctaatggtcatgatatgtcattcgtttcattagcacttctagtaaatggaatcgctggcgttattggaacatcattaggtggtatattctccgataaaattacaagtaagcgttggttaatgatttctgtttctatttttatcgtcatgatgttacttatgaatttaatcttacctggttcaggtctattgttagcaggactatttatttggaatatcatgcaatggagtactaatccagcagtgcaaagcggtgtgattcaacatgttgaaggcgacacaagccaagtaatgagttggaacatgtctagtttaaacgctggtattggtgttggaggcattattggaggcttggtcatgacacatgtttctgttcaagctatcacatatacgagtgccatcattggcgcattaggattaatcgttgttttcacattgaaaaataatcattatgctaaaacatttaaatcatca

SEQ ID NO: 5294 - protein, 402 aa, Staphylococcus aureus
  MISC_FEATURE (1)..(402): hypothetical protein
LFERSFKLSIMRLFTFILSIFIVGMVEMMVAGIMNLMSQDLHVSEAVVGQLVTMYALTFAICGPILVKLTNRFSSRPVLLWTLLIFIIGNGIIAVAPNFSILVVGRIISSAAAALIIVKVLAITAMLSAPKNRGKMIGLVYTGFSGANVFGVPIGTVIGDLVGWRYTFLFLIIVSIIVGFLMMIYLPKDQEIQRGPVNHETPSHENHVTSKILRPAEVAKYLIITFLVLIANSVTFVFINPLILSNGHDMSFVSLALLVNGIAGVIGTSLGGIFSDKITSKRWLMISVSIFIVMMLLMNLILPGSGLLLAGLFIWNIMQWSTNPAVQSGVIQHVEGDTSQVMSWNMSSLNAGIGVGGIIGGLVMTHVSVQAITYTSAIIGALGLIVVFTLKNNHYAKTFKSS

SEQ ID NO: 5295 - DNA, 774 bp, Staphylococcus aureus
atgagtaatacggcacttggattgacggcattgcttttagtcattccgattatcatttcatataaagaaggtttacatattattaaagatttaattgttgcgacattacgagcagttgtgcaattaatcattttgggatttttgctgcattatatttttaaaataaacgataaatggctgcttattttatgtgtattggtcattattattaatgcatcatggaatacaattagtcgagcatcaccagtgatgcatcatgtgttttggatatcatttctagctatcttcattggaacggcattaccgcttgcaggtactattgcgacaggggccattcaatttaccgcaaatgaagttatacctatcggcggcatgcttgcaaataatggcttgattgcaattaatttagcttaccagaatttagatcgtgcattcgtacaagatggtactaatattgaatctaaattatcacttgcagctacacctaaattggcttctaaaggtgcaatacgtgaaagtattcgtttagctatagtgccaactattgattcggttaaaacatatgggcttgtgtcgattcctggtatgatgacaggcttaattattggtggcgtaccacctttacaagcgattaaatttcaattgttagtcgtgtttattcatacaactgcgaccattatgtctgctttgattgcgacatatttaagctatggtcaatttttcaatgcaagacatcaattagtagcacgaaatactgatgttaagagtgaatca

SEQ ID NO: 5296 - protein, 258 aa, Staphylococcus aureus
  MISC_FEATURE (1)..(258): conserved hypothetical
MSNTALGLTALLLVIPIIISYKEGLHIIKDLIVATLRAVVQLIILGFLLHYIFKINDKWLLILCVLVIIINASWNTISRASPVMHHVFWISFLAIFIGTALPLAGTIATGAIQFTANEVIPIGGMLANNGLIAINLAYQNLDRAFVQDGTNIESKLSLAATPKLASKGAIRESIRLAIVPTIDSVKTYGLVSIPGMMTGLIIGGVPPLQAIKFQLLVVFIHTTATIMSALIATYLSYGQFFNARHQLVARNTDVKSES

SEQ ID NO: 5297 - DNA, 363 bp, Staphylococcus aureus
atggcacgtattgcaggagtagatattccacgtgaaaaacgcgtagttatctcattaacttatatatacggtatcggtacgtcaactgctcaaaaaattcttgaagaagctaacgtatcagctgatactcgtgtgaaagatttaactgatgacgaattaggtcgcatccgtgaagttgtagacggttataaagtcgaaggtgacttacgtcgtgaaactaacttaaatatcaaacgtttaatggaaatttcatcataccgtggtatccgtcaccgtcgtggtttaccagttcgtggtcaaaaaacgaaaaacaacgcgcgtactcgtaaaggaccagttaaaacggtagctaacaagaaaaaa

SEQ ID NO: 5298 - protein, 121 aa, Staphylococcus aureus
  MISC_FEATURE (1)..(121): 30S ribosomal protein S13
MARIAGVDIPREKRVVISLTYIYGIGTSTAQKILEEANVSADTRVKDLTDDELGRIREVVDGYKVEGDLRRETNLNIKRLMEISSYRGIRHRRGLPVRGQKTKNNARTRKGPVKTVANKKK

SEQ ID NO: 5299 - DNA, 666 bp, Staphylococcus aureus
gtgcaaatgttgttagaaattaaagatttagtgtataaagcgagcgatagaatcatactagatcatatcagtctaaaagtagataaaggcgagagtattgccattataggtccatcaggtagtggtaaaagtacatttcaaaagcaaatatgtaatttgtttagtccaactagtggagaactttattttaaaggtaaaccctataatgattatgacccggaagaattgcgtcaacgaatcagttatttgatgcagcaaagtgacttgtttggtgaaacgattgaagataacatgatattcccatcacttgcacgtaatgataaatttgatagaaaacgtgcaaagcaattaattaaagatgtcggtttgggacattatcaattaagttcggaagtggaaaatatgtcgggtggtgagcggcaaagaattgctatagcgcgccaactgatgtatacaccggatattcttttattagatgaatcgaccagtgcattagacgttaataataaagaaaagatagaaaatatcatttttaaattagcagatcaaggcgtggcaattatgtggattacccacagcgatgaccaaagtatgcgacactttcaaaagcgtataacaattgttgatggtcaaatttctaatacagaggagttgaatcaacatgag

SEQ ID NO: 5300 - protein, 222 aa, Staphylococcus aureus
  MISC_FEATURE (1)..(222): hypothetical protein
VQMLLEIKDLVYKASDRIILDHISLKVDKGESIAIIGPSGSGKSTFQKQICNLFSPTSGELYFKGKPYNDYDPEELRQRISYLMQQSDLFGETIEDNMIFPSLARNDKFDRKRAKQLIKDVGLGHYQLSSEVENMSGGERQRIAIARQLMYTPDILLLDESTSALDVNNKEKIENIIFKLADQGVAIMWITHSDDQSMRHFQKRITIVDGQISNTEELNQHE

SEQ ID NO: 5301 - DNA, 1098 bp, Staphylococcus aureus
ttgaaatacaggaggatgaataacatgaatcagtcagtcaaattacttaaacatttaacagatgtaaacggcattgctggttatgaaatgcaagttaaagaagcaatgcgtaactatatagagcctgtcagtgatcaaattattgaagataacttgggtggcatttttggaaagaaaaatgctgagaatggtcaatactcaattatgatttctggtcatatggatgaagttggttttatggtaacaaagattgataaacatggttttatttcatttacgccagttggtggatggtggaatcaagtcatgctatctcaaaaagtaacgattacaacagattcgggcaaagaaattagaggtatcatcggttctaaaccgccacatgtcttaacgcctgaagaacgtaaaaagccaatggaaatcaaaaatatgtttatagatattggtgttagtagcaaggaagaagctgaagaagctggcgttgaagtaggcaatatggttacgccatatagtgaatttgaagtgcttgcaaatgataaatatttaactgcgaaagcatttgataatcgctatggctgtgcattagctattgaggtattaaaacgtttaaaagatgaaaatattggcattaacttatacagtggtgccacagtgcaagaagaagttggtttgcgtggtgcgaaagtggcagcgaatacgattaaaccagacttggcgatagctgtcgatgtaggtattgcttatgataccccaggtatgtcaggtcaaacgagcgatagtaaactaggcggtggtccagttgtcattatgatggatgctacaagtattgctcaccaaggtttgcgaaagcatattaaagatgtagctaaggaacataacatcgaagtacaatgggatacgacaccaggtggaggtacagatgcgggaagtattcatgtcgcaaatgaaggtattccaacgatgacaatcggtgttacgctgcgatacatgcattctaatgtttcagtgctcaatgtagatgattatgaaaattctatccgtcttgttactgaaattgtccgttcattgaatgatgaaagttataaaaatatcatgtgg

SEQ ID NO: 5302 - protein, 366 aa, Staphylococcus aureus
  MISC_FEATURE (1)..(366): hypothetical protein
LKYRRMNNMNQSVKLLKHLTDVNGIAGYEMQVKEAMRNYIEPVSDQIIEDNLGGIFGKKNAENGQYSIMISGHMDEVGFMVTKIDKHGFISFTPVGGWWNQVMLSQKVTITTDSGKEIRGIIGSKPPHVLTPEERKKPMEIKNMFIDIGVSSKEEAEEAGVEVGNMVTPYSEFEVLANDKYLTAKAFDNRYGCALAIEVLKRLKDENIGINLYSGATVQEEVGLRGAKVAANTIKPDLAIAVDVGIAYDTPGMSGQTSDSKLGGGPVVIMMDATSIAHQGLRKHIKDVAKEHNIEVQWDTTPGGGTDAGSIHVANEGIPTMTIGVTLRYMHSNVSVLNVDDYENSIRLVTEIVRSLNDESYKNIMW

SEQ ID NO: 5303 - DNA, 474 bp, Staphylococcus aureus
atgttaggtgtcgcagtatctgtattaatttattggttaaatcctccaggcaatgcttggttagacaatgtctcattaattgcccttggtttcataatatatggaccagttatgttaattggtttacaagcattagattatgtacctaaaaaagcagctggctcagcagctggattaacaggactatttggttatctgtttggtgctgtaatggccaacatcgtcttaggttctgtagttgataaattcggatgggatgtcggttttattttattatcaccgcttaaagtgctttacgatccgaaggccttcatcactcacgcggcgttgctccgtcaggctttcgcccattgcggaagattccctactgctgcctcccgtaggagtctggaccgtgtctcagttccagtgtggccgatcaccctctcaggtcggctatgcatcgttgccttggtaagccgttaccttaccaac

SEQ ID NO: 5304 - protein, 158 aa, Staphylococcus aureus
  MISC_FEATURE (1)..(158): glycerol-3-phosphate
MLGVAVSVLIYWLNPPGNAWLDNVSLIALGFIIYGPVMLIGLQALDYVPKKAAGSAAGLTGLFGYLFGAVMANIVLGSVVDKFGWDVGFILLSPLKVLYDPKAFITHAALLRQAFAHCGRFPTAASRRSLDRVSVPVWPITLSGRLCIVALVSRYLTN

SEQ ID NO: 5305 - DNA, 183 bp, Staphylococcus aureus
gtgttaagcaataaacgcgttgaaaaagaagcgggttgtgaacacaaaaagtttttaaaaaagttattgactttaaattccaaagttgataatatgataaagtcgtcaaaaacgacgcagttgtttttaaagaagaatttcaaaagtgtaaaacttaccattgaaataactataaaaacaata

SEQ ID NO: 5306 - protein, 61 aa, Staphylococcus aureus
VLSNKRVEKEAGCEHKKFLKKLLTLNSKVDNMIKSSKTTQLFLKKNFKSVKLTIEITIKTI

SEQ ID NO: 5307 - DNA, 1062 bp, Staphylococcus aureus
ttgttaacggtagatcaagtgaaagaattggtaggagaaattaaagatcctattatagatgtgcctttaaaagaaacagaaggtattgttgaagtttctattaaggaagaaaaagaacatgtgagtgttaaattagcaatggcacaattaggtggtgcaccgcaattagatttacagatggctgttgttaatgcattaaaagaaaacggtgcgaaaacggtcggtatacgatttgaaacattgccggaagaaaaagtaaatcaatttaaaccaaaagaagaaaataaacctaaaacgatagaaggcctattatctcaaaataatccagtcgaatttattgcaatagcctccggtaaaggtggtgtcggtaaatctactgttgcagtaaatttagccgttgccttagctcgtgaagggaaaaaagtcggattagtagatgccgatatatatggatttagtgtaccagatatgatgggtattgatgaaaagcctggaattaaagggaaggaagtaattccagttgaacgtcatggcgttaaagttatatcaatggccttttttgtggaagaaaatgcgccagttatatggagagggccaatgttaggtaaaatgttgacgaatttctttacagaagttaaatggggagacattgaatatttaatactcgatcttccacctggaacaggagatgtagctttagatgttcatacgatgttaccttcaagtaaggaaattattgtaacgacacctcatcctacagcagcatttgttgcagctcgcgcaggtgcgatggcaaaacatacggatcattctattcttggcgtaattgaaaacatgagttattttgaaagtaaagagacgggtaataaagaatatgtctttggcaaaggtggcggtactaagttagctgatgaacttaatactcaattacttggggaattacctttagagcaaccatcttggaatccaaaagattttgcgccgtcaatatatcaatcagatgatcgtctaggtaaaatttatagctcgattgcacaaaaagttatagctgctacaaataaa

SEQ ID NO: 5308 - protein, 354 aa, Staphylococcus aureus
  MISC_FEATURE (1)..(354): hypothetical protein
LLTVDQVKELVGEIKDPIIDVPLKETEGIVEVSIKEEKEHVSVKLAMAQLGGAPQLDLQMAVVNALKENGAKTVGIRFETLPEEKVNQFKPKEENKPKTIEGLLSQNNPVEFIAIASGKGGVGKSTVAVNLAVALAREGKKVGLVDADIYGFSVPDMMGIDEKPGIKGKEVIPVERHGVKVISMAFFVEENAPVIWRGPMLGKMLTNFFTEVKWGDIEYLILDLPPGTGDVALDVHTMLPSSKEIIVTTPHPTAAFVAARAGAMAKHTDHSILGVIENMSYFESKETGNKEYVFGKGGGTKLADELNTQLLGELPLEQPSWNPKDFAPSIYQSDDRLGKIYSSIAQKVIAATNK

SEQ ID NO: 5309 - DNA, 1443 bp, Staphylococcus aureus
atgatggctaaagttgaattaacaacccggagacgaaacttcatagttgctgttatgttgattagtgcgtttgtagctattttaaatcaaacattattaaatacagcgttacctagtataatgagagaattaaatatcaatgaaagtacatcgcaatggctagttactgggtttatgcttgttaatggcgtcatgatacctctgacggcatatctaatggatagaattaaaactagacctttatacttagcggcgatggggacatttttattaggttctattgttgcagccttagctccgaattttggagttttaatgttagctcgtgtaattcaagcgatgggtgcaggcgtacttatgcccttaatgcaatttacgttatttacattgttcagtaaagaacatcgaggttttgcaatgggactagcaggtttagtaattcaatttgcaccagcaataggacctacagttacaggattaattattgatcaagcgagttggcgagttccatttattataattgtaggaattgctatacttgcctttgttttcggtttggtttcaatctcgagttacaatgaagtgaaatatacgaaattagataagcgttcagtaatgtattcaactattgggttcgggttaatgctatacgcatttagtagtgcaggagatttaggatttacaagtccaatagtaataggtgcgttgatattaagtatggttattatctatttatttatacgtagacaatttaatattactaatgcacttttaaatttaagggtttttaaaaatagaacatttgcattatgtacgattagttcaatgattataatgatgtcaatggttggacctgcgctgcttataccgctatatgttcaaaacagtttatctttatctgccttgttatcaggacttgttatcatgcctggtgcaataataaatggtattatgtcagtttttacaggtaaattttatgataagtatggtcctagaccattgatttatactggttttacaattttaacaattactacaattatgttgtgtttcttgcatacagacacatcttatacgtatttaatagtcgtatatgcaattagaatgttttcagtttctttactcatgatgccgataaatactacaggaattaattctttgagaaatgaagaaatctcacatggcacggctattatgaactttggtcgtgtaatggctggttcactaggcacagctttaatggttacattaatgagttttggtgcaaaaatatttttatctacatcgccatcgcatttaactgcaactgaaattaaacagcaatccattgctataggggtggatatctcatttgcttttgtagctgtgcttgttatggcagcttatgtgatagcactttttataagagaacctaaagaaatagaaagtaatagaaggaaattt

SEQ ID NO: 5310 - protein, 481 aa, Staphylococcus aureus
  MISC_FEATURE (1)..(481): hypothetical protein
MMAKVELTTRRRNFIVAVMLISAFVAILNQTLLNTALPSIMRELNINESTSQWLVTGFMLVNGVMIPLTAYLMDRIKTRPLYLAAMGTFLLGSIVAALAPNFGVLMLARVIQAMGAGVLMPLMQFTLFTLFSKEHRGFAMGLAGLVIQFAPAIGPTVTGLIIDQASWRVPFIIIVGIAILAFVFGLVSISSYNEVKYTKLDKRSVMYSTIGFGLMLYAFSSAGDLGFTSPIVIGALILSMVIIYLFIRRQFNITNALLNLRVFKNRTFALCTISSMIIMMSMVGPALLIPLYVQNSLSLSALLSGLVIMPGAIINGIMSVFTGKFYDKYGPRPLIYTGFTILTITTIMLCFLHTDTSYTYLIVVYAIRMFSVSLLMMPINTTGINSLRNEEISHGTAIMNFGRVMAGSLGTALMVTLMSFGAKIFLSTSPSHLTATEIKQQSIAIGVDISFAFVAVLVMAAYVIALFIREPKEIESNRRKF

SEQ ID NO: 5311 - DNA, 471 bp, Staphylococcus aureus
atgattgtgaattatcttaaacataagttttataacttgttaactacaatgattgttctctttatttttgtactttctggtgcgatttttttaacatttctagggtttggtttatatggattaagtagaatacttatttattttaggttgggtgactttacatataatagaagtatgtacgataacctattatattatggcagttatataatctttgggtacttcatcatatttgcagtcgagcatttaatggattattttagaaaaatgttgcctgaaaatgcatattttagaggcgcgacttttcatttgatttcttacacagttgcaacaacgttattttattttattattcatctgaactatgtgtatatcaatatcgatttttgggtcatcatggttattatagggttcttatatgtttgtaagcttcaattttaccctgaaagtaaaaatttaaataatagaaaa

SEQ ID NO: 5312 - protein, 157 aa, Staphylococcus aureus
  MISC_FEATURE (1)..(157): hypothetical protein
MIVNYLKHKFYNLLTTMIVLFIFVLSGAIFLTFLGFGLYGLSRILIYFRLGDFTYNRSMYDNLLYYGSYIIFGYFIIFAVEHLMDYFRKMLPENAYFRGATFHLISYTVATTLFYFIIHLNYVYINIDFWVIMVIIGFLYVCKLQFYPESKNLNNRK

SEQ ID NO: 5313 - DNA, 1341 bp, Staphylococcus aureus
atgcgattaaagtcaatcataactgttatagctttaatattaattatgtttatgtcagcgattgaatcatctattatttcgcttgcattacctacaattaaacaagatttaaatgcaggaaatttaatttcattaattttcacagcgtattttatcgcattagtaattgccaatcctatagtgggcgaattactttcgagatttaaaattatttatgtggcaattgcaggattacttttatttagtataggtagttttatgtgtggtttaagtactaattttactatgctaattatatcacgcgtgatacaaggttttggatcaggtgtattgatgtcattatcgcaaattgttccaaagttagcatttgaaattccgttacgatataaaattatgggcatagttggcagtgtttggggtatttcgagtatcattgggccacttctaggtggtggtatattagaatttgcaacatggcattggttattctacataaatataccgattgcgatcattgccattatattagttatatggacatttcattttccagaggaagaaacagttgctaaatcaaaatttgatactaaagggctcacgctattttatgtatttattggattgattatgtttgctttattaaaccaacagctgttacttttaaatttcttgagttttatcttagctatcgttgtggcaatgtgtttatttaaagtagaaaaacatgtttcttcaccatttttacctgtggttgaatttaatcgttcgattactttagtttttataactgaccttctaacagctatttgtttaatgggattcaatttatatattccagtctaccttcaagaacaactaggattatctccattgcaaagtggattggttatttttcctttatctgtagcttggattacattgaattttaatttacatcgaattgaagcaaaactatcaaggaaagttatttacttactatcatttacattgctactagtaagtagtattatcatttcatttggtattaaattgccggtacttatagcatttgtgttaattttggcaggattaagttttggatatatttatacgaaagatagtgtgattgtccaagaggaaactagcccattacaaatgaagaaaatgatgtcattttatggattaactaaaaatcttggggcatcaataggttcaacaataatgggatatctttatgcgatacaatcaggaatctttggtccaaacttacacaatgtgttaagtgctgttgctgtaattagcattgggcttattgttttatgggtcgtattttttaaagaacagtcatctcaatcaaaagaa

SEQ ID NO: 5314 - protein, 447 aa, Staphylococcus aureus
  MISC_FEATURE (1)..(447): hypothetical protein
MRLKSIITVIALILIMFMSAIESSIISLALPTIKQDLNAGNLISLIFTAYFIALVIANPIVGELLSRFKIIYVAIAGLLLFSIGSFMCGLSTNFTMLIISRVIQGFGSGVLMSLSQIVPKLAFEIPLRYKIMGIVGSVWGISSIIGPLLGGGILEFATWHWLFYINIPIAIIAIILVIWTFHFPEEETVAKSKFDTKGLTLFYVFIGLIMFALLNQQLLLLNFLSFILAIVVAMCLFKVEKHVSSPFLPVVEFNRSITLVFITDLLTAICLMGFNLYIPVYLQEQLGLSPLQSGLVIFPLSVAWITLNFNLHRIEAKLSRKVIYLLSFTLLLVSSIIISFGIKLPVLIAFVLILAGLSFGYIYTKDSVIVQEETSPLQMKKMMSFYGLTKNLGASIGSTIMGYLYAIQSGIFGPNLHNVLSAVAVISIGLIVLWVVFFKEQSSQSKE

SEQ ID NO: 5315 - DNA, 690 bp, Staphylococcus aureus
gtgactatgatgtccaaatcaactaaaaaaagtaatgacacaatcgtagaaacatttaaggatatcatccctttatcatttggagaagaaattggtaatgcggcatctcatggtgttgcagctttgttaacattattagtgttaccctatgcggctgtgcacagttatattgcacatggtacgcttgcgtctgtgagtatgtctatttatgttatttctatctttatgatgtttatttcatctactatttatcattctatgcaaaatgaaacacctcataaatatattttaaggattatcgatcacagtatgatttacgtagcaatttctggtacatatacgcctattttgttaacagttgtaggtggttggataggttggacagtatttattttattatggggaacgacactttgggggattttatataaatccatagctgtcaaagttaaccaaaagttaagcttaattgtctatttagtgatgggctgggtaggtattatcttgttaccaattatttttattcgcacatcatggatattcatattattcattttcttaggtggtgtgtcttatacaattggtgcatggttttatgcacaaaagaatagaccatattttcatatgatttggcatatttttattgtaatagcatcactattgcatttaattgcaatcttatattttatg

SEQ ID NO: 5316 - protein, 230 aa, Staphylococcus aureus
  MISC_FEATURE (1)..(230): hypothetical protein
VTMMSKSTKKSNDTIVETFKDIIPLSFGEEIGNAASHGVAALLTLLVLPYAAVHSYIAHGTLASVSMSIYVISIFMMFISSTIYHSMQNETPHKYILRIIDHSMIYVAISGTYTPILLTVVGGWIGWTVFILLWGTTLWGILYKSIAVKVNQKLSLIVYLVMGWVGIILLPIIFIRTSWIFILFIFLGGVSYTIGAWFYAQKNRPYFHMIWHIFIVIASLLHLIAILYFM

SEQ ID NO: 5317 - DNA, 111 bp, Staphylococcus aureus
atgaaagtaagaccatcagtaaaacctatttgcgaaaaatgtaaagtcattaaacgtaaaggtaaagtaatggtaatttgtgaaaatccaaaacacaaacaaagacaaggt

SEQ ID NO: 5318 - protein, 37 aa, Staphylococcus aureus
  MISC_FEATURE (1)..(37): 50S ribosomal protein L36
MKVRPSVKPICEKCKVIKRKGKVMVICENPKHKQRQG

SEQ ID NO: 5319 - DNA, 1122 bp, Staphylococcus aureus
atgagtaacaatgaaaaagaagcacttgaagagaaggtagcgtcattagatttagattttattgccaaattatataacgatttatacatcaataagaaaacaatagatgatgtatctgcagtttctgaagtgaaatatgatattaaatcacaaatgagtgatgatgagattaagcgtttagaggaacaaggacttcaagctattaaagaaggacaatttgcagtacttttgatggcaggtggtcaaggaacaagacttggttacaagggccctaaaggttcgtttgaaattgaaggtgtaagtttatttgaacttcaagctaaccaattaaaaacattgaatcatcaatctggacatacgattcaatggtatattatgacaagtgatatcaatcatgaagaaactttagcttatttcgaagcacatagttattttggatatgatcaagaagcaatccatttctttaaacaagataatattgtggcgcttagtgaagaagggaagttaattttaaatcaacagggtcgtattatggaaacgccgaatggtaatggtggcgtgtttaaatctttagacaaggcaggatacttagaagaaatgtctaataatggcgttaagtatattttcttgaataatatcgacaatgttttagtaagagtgttggatccactatttgcaggatttacggtagaacatgattacgatattacttctaaaacgattcaaccaaaaccaggagaaagtgttggacgtttagttaatgtcgattgtaaagatacagtactggagtattcagaattagatccagaagttgcaaatcaatttaacaatgctaatatcggtattcatgcatttaaacttggttttattttaaacgctgtaaatcgtgagttaccttatcatttagctattaagaatttgaagcaattagatgagaactttggtgttattgaacaaccaactttaaaattcgaattgttctattttgacatatttacttatggaactagttttgtcacgttacaagttcctagagaagaagaattttcacctcttaaaaataaagaaggtaaagatagtgttgcaactgcaacagaagatttacgtagaatgggtttaatt

SEQ ID NO: 5320 - protein, 374 aa, Staphylococcus aureus
  MISC_FEATURE (1)..(374): hypothetical protein
MSNNEKEALEEKVASLDLDFIAKLYNDLYINKKTIDDVSAVSEVKYDIKSQMSDDEIKRLEEQGLQAIKEGQFAVLLMAGGQGTRLGYKGPKGSFEIEGVSLFELQANQLKTLNHQSGHTIQWYIMTSDINHEETLAYFEAHSYFGYDQEAIHFFKQDNIVALSEEGKLILNQQGRIMETPNGNGGVFKSLDKAGYLEEMSNNGVKYIFLNNIDNVLVRVLDPLFAGFTVEHDYDITSKTIQPKPGESVGRLVNVDCKDTVLEYSELDPEVANQFNNANIGIHAFKLGFILNAVNRELPYHLAIKNLKQLDENFGVIEQPTLKFELFYFDIFTYGTSFVTLQVPREEEFSPLKNKEGKDSVATATEDLRRMGLI

SEQ ID NO: 5321 - DNA, 513 bp, Staphylococcus aureus
atgacaggtaaaacacatgcttcatgcggcatgctcgttggagcgctaacaacacaatattttcaaacggatattttttcgtcggttacggttatcattctagcaactctagctagcttattacccgatatatgtcacactcaaagtaagattggcagaaggtttaaggtaattagtttttttgtgagattgatctttggacatcgaacctttacgcattcaatattatttatcgcaatcatagcatttttattgcaaattattcagacgcctaattattatatggcagcaattataattggattagtgtcacatgttatactagatatgataacaccaaaaggcgtgaaattattttatccgttaccgtttaatgtgaagacaccgattcaatttaaaacaggtggacttgtagacttatctttagctacagcgttaatggtcggaacagtttatgttttatttcagcctttcatcaatgatataataagcaactggaatactaagttttta

SEQ ID NO: 5322 - protein, 171 aa, Staphylococcus aureus
  MISC_FEATURE (1)..(171): conserved hypothetical
MTGKTHASCGMLVGALTTQYFQTDIFSSVTVIILATLASLLPDICHTQSKIGRRFKVISFFVRLIFGHRTFTHSILFIAIIAFLLQIIQTPNYYMAAIIIGLVSHVILDMITPKGVKLFYPLPFNVKTPIQFKTGGLVDLSLATALMVGTVYVLFQPFINDIISNWNTKFL

SEQ ID NO: 5323 - DNA, 258 bp, Staphylococcus aureus
atggcaatgacagtaaaaaaggataataatgaagtgcgtattcaatggagagttgctgatatcaaaattcctacaagtgaaattaaaaatattacacaagaccaagatattcatgcagttcctaaattagacagcaaagatgtatctagaatcggctcaacgtttggtaaaacgaatcgcgttattatcgatactgaagaccacgaatacattatttatactcaaaatgatcaaaaggtttacaatgaattaactaaa

SEQ ID NO: 5324 - protein, 86 aa, Staphylococcus aureus
  MISC_FEATURE (1)..(86): conserved hypothetical
MAMTVKKDNNEVRIQWRVADIKIPTSEIKNITQDQDIHAVPKLDSKDVSRIGSTFGKTNRVIIDTEDHEYIIYTQNDQKVYNELTK

SEQ ID NO: 5325 - DNA, 1368 bp, Staphylococcus aureus
atggatagcttttcaaggaaagagatagttattgggagacttaagtttattacgatgtctttaattggtatcttattatttttagtaccaattccagtcgaacaagatggacagaagcaaacaacgttgcccgtggcatttttagcaggcgtgcttaaagatgtattaggtggcgtaatgccatttttaattgtgacgataattactttatcgggtatcataactctgatttgttcaactattttaaaagataaattgaaacctgacgggctaatgaacaatgcttttaacgttagaattggttggttaattttacgaatattagcagttgtttttgcatggatgacatttttacgaattggttcaaaggttatttactcagatgaaacgggtggattattgttctcaagtttattgccaacattagtggcagtattcttatttgcagctctatttttaccgctattaatggaatacggtttgttagagatgttgggtcctatttttagaccggttatgagacctttatttacattgccaggacgttcgacggtagataatttagcatcatttattggagacggaactgttggtgtcttaattacaagtagacaatatggtgaaggatattattctcgtcgtgaggcaacagttatttcaacgacatttagtgtagtttctatcacctttgcaattgtagttgctgaaacagtgcacatgcaaaatcaattttttgctttctatttatcagtgatagtatcctgcctcgttgcagcagtcattatgccaagaatttggcctttaaataaaattcctgatgagtatgctaaggaggtacctgaaagtgcgcgtactgaggcattgccagaaggaaagacggcattgagacatggctttgatactgcaacagaagtaggtattaaagcaccgggcgttattgacttttttaagtcaggattaaaaacagtcattgatatgtggtttgttattttgcctgtagtaatgagtattggtactattgctaccattattgcgaactacacgcccttttttgtcatattgggtaaaccttttgttccatttttagagttaatgcaaatacctgaagcggcacaggcttctcaaacgattattatcggttttgccgatatgtttttaccttctatattaattgaaggtgtacaaaatgatataactcgttttgttattggggcacttagtatatcgcagttaatatacttgtctgaagtaggtggcgtcatacttggttcgaagattcctgtaagcatcggcaaattgtttatgattttcttgattagaacaatcattacactaccaattatttctttgatggcacatcttttgtta

SEQ ID NO: 5326 - protein, 456 aa, Staphylococcus aureus
  MISC_FEATURE (1)..(456): conserved hypothetical
MDSFSRKEIVIGRLKFITMSLIGILLFLVPIPVEQDGQKQTTLPVAFLAGVLKDVLGGVMPFLIVTIITLSGIITLICSTILKDKLKPDGLMNNAFNVRIGWLILRILAVVFAWMTFLRIGSKVIYSDETGGLLFSSLLPTLVAVFLFAALFLPLLMEYGLLEMLGPIFRPVMRPLFTLPGRSTVDNLASFIGDGTVGVLITSRQYGEGYYSRREATVISTTFSVVSITFAIVVAETVHMQNQFFAFYLSVIVSCLVAAVIMPRIWPLNKIPDEYAKEVPESARTEALPEGKTALRHGFDTATEVGIKAPGVIDFFKSGLKTVIDMWFVILPVVMSIGTIATIIANYTPFFVILGKPFVPFLELMQIPEAAQASQTIIIGFADMFLPSILIEGVQNDITRFVIGALSISQLIYLSEVGGVILGSKIPVSIGKLFMIFLIRTIITLPIISLMAHLLL

SEQ ID NO: 5327 - DNA, 966 bp, Staphylococcus aureus
atgatgacaacgaaaattatacgtcgttatagtttaatcacaatccttttaattgtgagtatattcataagtttatgtgtagggtctgtcatgattcatccgattgatgctattaagggaatctttacacaagatgattttattttaaatgagtatcgtatacctagaacattacttggtattattatcggtagtagcttggctatttcaggtgcaattatacaagctgtaataagaaacccgttagcctcacctgatgttataggtatttctaaaggtgccagtttagctgctgtgattattattatgacctttccaacagcaccattgtttgtattacctataggttcattcttaggtgcctttgcagtaagtttatttttatcatttttaatttcaaaatatgatgttaaaggttcaaagcttgccttaattggtttagcaataggcgcaatatgtacggcgattgtgcagttcttattaatcagaaatccactggaagcaaacaaagcgcttgtttggttgacaggtagtctatatggacatgatatgtcgaatatttatactatattaccttggtttttaataacgataccaatcatcattttattgagttatcaattagatgtattgaatctaggtgatgctgttgcaaccgcactcggtttaaaagttaaaactattaaaatgctattgttaattttagcagtaatattagcaggatccgcaatttcagttgtcggtggtattagctttttaggattaattgcacctcatattgcgagacaattaataggaaataaaacattacacgttattatcatgtcggggttaattggtgctatattgttaacatttggagatggtttagcccgtggcattcatccgccactggatattcctgttggggttatcattgcaattatcggtgcaccatacttcttaatattattacgaagaatgaaa

SEQ ID NO: 5328 - protein, 322 aa, Staphylococcus aureus
  MISC_FEATURE (1)..(322): hypothetical protein
MMTTKIIRRYSLITILLIVSIFISLCVGSVMIHPIDAIKGIFTQDDFILNEYRIPRTLLGIIIGSSLAISGAIIQAVIRNPLASPDVIGISKGASLAAVIIIMTFPTAPLFVLPIGSFLGAFAVSLFLSFLISKYDVKGSKLALIGLAIGAICTAIVQFLLIRNPLEANKALVWLTGSLYGHDMSNIYTILPWFLITIPIIILLSYQLDVLNLGDAVATALGLKVKTIKMLLLILAVILAGSAISVVGGISFLGLIAPHIARQLIGNKTLHVIIMSGLIGAILLTFGDGLARGIHPPLDIPVGVIIAIIGAPYFLILLRRMK

SEQ ID NO: 5329 - DNA, 1029 bp, Staphylococcus aureus
atggctataaaagaaataagtagccaatctgccatagatcataaaagaaaaagacgcacaacactcacgtatatagtgagtttgtgctttctttttatttgtatatatttaaatatggcgattggttcttcgaaaattaattttagcgatatcattcactatgttactggtcatacagatacgaaagcaacgtttttattgcataatgtacgtatgccaaggatgattgcagggttatttattggcggtgcattagcggtatctggtttgttaatgcaagcaatgacacgcaatccgctagcatcacctaaaatttttggtgtcagttctggtgcatcgtttttcattgtatttgtgacgattatcattccagcattagaatattatgcattatatttaggtgtgataggtgcatttataggtggtttaactgtttatacactttcaggtgctacgaaaggtatgacacccattaaattagcattggctggtatggccatccatttgttttttagtagtatgaccgaaggtattattattttgaatgagaattcaaacgaacaagtgatgttttggcttgtcggttcattatccagtatgaagtgggatgaaattttaaccattctaccatggattattggtgctttaattgtaacgatttttattggacgtcaactaacgataatggaactaggcgatgacattgctaagggattgggtcaaaatataaataaagttagaattatcattggactattagtcattattcttacaggtatgtcggtgtcagtggcaggaccaattggatttgttggcttaatcgtaccgcatatagtcaaacgctatgtgagtaagaattatttagtcatgattccattaacatttattataggtgcagatttgttactactatcagatgtattaagtcgtttaattacatatccttatgaatcaccagtagggattgttacatcattcgtaggtgcactttacttcttatttataacgattaaaggggtgaaaagaata

SEQ ID NO: 5330 - protein, 343 aa, Staphylococcus aureus
  MISC_FEATURE (1)..(343): hypothetical protein
MAIKEISSQSAIDHKRKRRTTLTYIVSLCFLFICIYLNMAIGSSKINFSDIIHYVTGHTDTKATFLLHNVRMPRMIAGLFIGGALAVSGLLMQAMTRNPLASPKIFGVSSGASFFIVFVTIIIPALEYYALYLGVIGAFIGGLTVYTLSGATKGMTPIKLALAGMAIHLFFSSMTEGIIILNENSNEQVMFWLVGSLSSMKWDEILTILPWIIGALIVTIFIGRQLTIMELGDDIAKGLGQNINKVRIIIGLLVIILTGMSVSVAGPIGFVGLIVPHIVKRYVSKNYLVMIPLTFIIGADLLLLSDVLSRLITYPYESPVGIVTSFVGALYFLFITIKGVKRI

SEQ ID NO: 5331 - DNA, 1044 bp, Staphylococcus aureus
ttgacaatgataattgttatcaataaaataataaatgaagttatacatattaaggagtggaacgatgagaggtctaaaccttttagtatattgggattaatagttgccttacttttagttgcagcttgtggtaatacggataattcaagtaaaaaagaatcatcaactaaagatactatttcggtaaaagatgaaaatggtacagtaaaagtacctaaagatgcaaaacgtatcgttgtattagagtactcatttgcagatgcattagcagcattagacgttaaaccagttggtattgctgatgatggtaagaaaaaacgtatcattaaaccagttagagaaaaaattggggattatacttctgtaggtacacgtaaacagccaaacttagaagaaattagtaaattaaaaccggatttaattatcgctgatagcagtagacataaaggtattaataaagaattaaacaaaattgcaccaacattatcattaaagagttttgatggagactacaaacaaaatattaattcgttcaaaacaattgctaaagctttaaataaagaaaaagaaggcgaaaaacgtcttgctgagcatgataaattaatcaataagtataaagatgaaattaaatttgatagaaatcaaaaagtgcttccagcagtagttgctaaagctggtttattagcacatccaaactattcatatgttggacaatttttaaacgaactaggatttaaaaatgcattaagtgacgatgtaacaaaaggtttaagtaaatatttgaaaggaccttacttacaattagacactgaacatttagctgatttaaatccagagcgtatgatcattatgacagatcatgctaaaaaagattctgctgaattcaagaagttacaagaagatgcaacatggaaaaagttgaatgcagttaaaaataatcgcgtggatattgttgaccgtgatgtttgggcaagatctcgtggcttaatttcttctgaagaaatggctaaagaacttgttgaattatcaaaaaaagaacaaaag

SEQ ID NO: 5332 - protein, 348 aa, Staphylococcus aureus
  MISC_FEATURE (1)..(348): hypothetical protein
LTMIIVINKIINEVIHIKEWNDERSKPFSILGLIVALLLVAACGNTDNSSKKESSTKDTISVKDENGTVKVPKDAKRIVVLEYSFADALAALDVKPVGIADDGKKKRIIKPVREKIGDYTSVGTRKQPNLEEISKLKPDLIIADSSRHKGINKELNKIAPTLSLKSFDGDYKQNINSFKTIAKALNKEKEGEKRLAEHDKLINKYKDEIKFDRNQKVLPAVVAKAGLLAHPNYSYVGQFLNELGFKNALSDDVTKGLSKYLKGPYLQLDTEHLADLNPERMIIMTDHAKKDSAEFKKLQEDATWKKLNAVKNNRVDIVDRDVWARSRGLISSEEMAKELVELSKKEQK

SEQ ID NO: 5333 - DNA, 1068 bp, Staphylococcus aureus
atggcacacgttaacataaatatatcgaagattaaatataacgccaaagtacttcaaacagtttttcaaagtaaaaatatgcaattcacaccagtaattaagtgcatagctggtgaccgtacaattgtagaaagcttaaaagcgttaggtatcaatcatgttgcagaatccagattggataacataattagtattgcagatcaggatttaacatatacgttattgcgtacgcctgccaaaaaagagatttcagatatgatagaaaaagttgatatgagtatccaaacagaattatctaccatacatcaaataaatgaagtagcagaagttttaggaaaaaaacataagattttattaatggtagattggaaagatggccgtgaaggtgttctgacttatgatgttttagattatattaaagagattattcacttgaaaaatatccattttgtaggtttagcattcaattttatgtgttttaaatctgatgcgccaagtgatgatgatatctttatgattaatcgattcgtctcagctgttgaaagagaaataggatatcgattgaaaattatttcaggtggtaattcgagcatgttaccacaacttttatataatgatttgggtaaaataaatgaattgcgaataggtgaaacgttgtttagaggtgttgatacaacgacaaatcaagcgatcgctatgttatatcaagatgcgattacattggaggctgagattttagaaattaaacctcgagttaatacacaaacgcatgaatcattcttacaagctattgtagatattggttatttagatacaaaagtcgataatatttcacctatggatcagcatatcaatattttaggcgcttcgagtgatcatttaatgcttgatttaaatggtcaaggacactatcaagttggagatcatatatctttttcattaaattatgaagcactttctcattcgatgtatatgaaaaatttacataaggtatatattgatgattcaaagattgatacgctacttcaaaattttgatgtgaaatctcctgctatggtaaaccactat

SEQ ID NO: 5334 - protein, 356 aa, Staphylococcus aureus
  MISC_FEATURE (1)..(356): conserved hypothetical
MAHVNINISKIKYNAKVLQTVFQSKNMQFTPVIKCIAGDRTIVESLKALGINHVAESRLDNIISIADQDLTYTLLRTPAKKEISDMIEKVDMSIQTELSTIHQINEVAEVLGKKHKILLMVDWKDGREGVLTYDVLDYIKEIIHLKNIHFVGLAFNFMCFKSDAPSDDDIFMINRFVSAVEREIGYRLKIISGGNSSMLPQLLYNDLGKINELRIGETLFRGVDTTTNQAIAMLYQDAITLEAEILEIKPRVNTQTHESFLQAIVDIGYLDTKVDNISPMDQHINILGASSDHLMLDLNGQGHYQVGDHISFSLNYEALSHSMYMKNLHKVYIDDSKIDTLLQNFDVKSPAMVNHY

SEQ ID NO: 5335 - DNA, 1755 bp, Staphylococcus aureus
atggtatatcttgaatgggcaaaggcagatagaaatattcaatatcgtgtaattaacgccattattaaagaacgtatttaccccgagcaaacatttatttcgcaaaaaggatctttaattgaaattcagtatcatatgcatgtgttgactattgaagttgttagaaaaagtgcattagaacgctatgagtttacaggtgatattacttatttaaataaaggtgaaacgtcattaattataactttagaaggtttattagatgtgttgaatcatgactttgatatccctatttcagagcgactacgcgaagagttaatacacagtcgagatagtttagttgaaacatataagcaaatgtctcacagacaaacgttaataagtcaaagttttaaattttcaaggttaccacaagatattaactttttttcatggttacaacatgtaaaagatagtgataagacagatgatttaacttattctgagagtttggtaccagaggggcatccaacacaccctttaaccaaaacgaaattgcccttaactatggaagaagtacgagcatatgcacctgagtttgaaaaagaaatccctttgcaaattatgatgattgaaaaagaccatgttgtgtgcacagctatggatggtaatgatcaatttattattgatgaaataattcccgaatactacaatcagattcgtgtgtttttaaagagtttaggtttgaaaagtgaagactatagagcgattttagtacatccttggcaatatgatcatacgatagggaaatattttgaagcatggattgctaaaaaaatattaattccaacgccgtttacaatactttcaaaagcaactttatcatttaggacgatgtctttaattgataaaccataccatgttaagttgcccgtcgatgcacaagcaacaagtgccgttagaacagtctcaactgtgactactgtagatggaccaaagttaagttatgctttacaaaacatgttgaatcaatatccaggatttaaagttgctatggaaccgttcggtgaatatgcaaatgttgataaagatagggcacgtcagcttgcttgtattataagacaaaagcctgaaattgatggaaaaggtgcaacagtagttagtgcaagtctagttaataaaaatccaatagatcaaaaagttatcgtggatagttacttagagtggttaaatcaaggaattactaaagaaagtattacgacatttattgaacgatacgctcaagcattaatcccgcctttaattgcttttattcaaaattatggaattgctttagaagcacacatgcaaaatacagtagtgaacttggggccacattttgacattcaatttttagtgagagatttaggtggttctagaattgatttagaaacattacaacatcgtgtatcagatattaaaattacaaatgatagtttaatagctgattctatagatgcagtgattgcaaaattccaacatgctgttattcaaaatcaaatggcagaattaatccatcattttaatcagtatgattgtgttgaagaaaccgaattatttaacatagtacagcaagtagtagcgcatgccattaacccaacactaccacatgcaaatgagttaaaagatattttgtttggaccaacaattactgtcaaagcgttgttaaatatgagaatggaaaataaagtaaagcaatatttaaatattgagttagataatccgataaaaaaagaggtg

SEQ ID NO: 5336 - protein, 585 aa, Staphylococcus aureus
  MISC_FEATURE (1)..(585): conserved hypothetical
MVYLEWAKADRNIQYRVINAIIKERIYPEQTFISQKGSLIEIQYHMHVLTIEVVRKSALERYEFTGDITYLNKGETSLIITLEGLLDVLNHDFDIPISERLREELIHSRDSLVETYKQMSHRQTLISQSFKFSRLPQDINFFSWLQHVKDSDKTDDLTYSESLVPEGHPTHPLTKTKLPLTMEEVRAYAPEFEKEIPLQIMMIEKDHVVCTAMDGNDQFIIDEIIPEYYNQIRVFLKSLGLKSEDYRAILVHPWQYDHTIGKYFEAWIAKKILIPTPFTILSKATLSFRTMSLIDKPYHVKLPVDAQATSAVRTVSTVTTVDGPKLSYALQNMLNQYPGFKVAMEPFGEYANVDKDRARQLACIIRQKPEIDGKGATVVSASLVNKNPIDQKVIVDSYLEWLNQGITKESITTFIERYAQALIPPLIAFIQNYGIALEAHMQNTVVNLGPHFDIQFLVRDLGGSRIDLETLQHRVSDIKITNDSLIADSIDAVIAKFQHAVIQNQMAELIHHFNQYDCVEETELFNIVQQVVAHAINPTLPHANELKDILFGPTITVKALLNMRMENKVKQYLNIELDNPIKKEV

SEQ ID NO: 5337 - DNA, 1191 bp, Staphylococcus aureus
atgacaaaatatttttttagcagttcttttctactatttctaggtaattggattggacaaatagggctaaattggtttgtacttaccacttatcataacgcagtttatctggggattgtcaatttttgcagacttgtaccaatattattactaagtgtgtgggcaggggcaattgccgataaatatgataaagggcgattgctgagaattacaatttcatcatcatttttagtaactgcaattttatgtgtgctcacgtatagtttcactgcaattccaattagcgtcattattatatatgcgacattaagagggattttaagtgcggttgaaacacctttaagacaagcaatcttaccagatttatcagataaaatatctactacacaagctgtatcatttcattcattcatcattaatatttgtcgttcaatagggcctgccattgctggtgtcatattagcagtctatcatgcgccaacaacatttcttgcacaggcaatttgttattttatcgcagttttattatgcttaccattacattttaaagtaactaaaatacctgaagatgcatcaagatacatgccgttaaaagttattatagattacttcaaattacatatggaaggtcgacaaatatttataacatcattattgattatggcgacaggtttttcatatacgacacttttaccagttttgacaaacaaagtatttccggggaaatctgaaatatttggtatcgctatgacgatgtgtgccattggtggtattattgcaacgctagttttacctaaagtacttaaatatattggtatggtaaatatgtattatttaagttcatttttatttggcattgctttgttaggtgtggtatttcacaatattgtcatcatgttcatttgtattacattgattgggttatttagtcaatgggcacgtacgacaaatcgcgtttattttcaaaataatgttaaagattatgaacgtggtaaagtactgagtattattatgatggatagaggtatgattccattgggaagtctattaatgagtatatgtgcagatgtgtttggcattgttagaactttttcaataatgggaataagtactatatgcattacaatggtattctattttataaatagaaagttgaagttaaagttggaggaaagtaatcatggtatatct

SEQ ID NO: 5338 - protein, 397 aa, Staphylococcus aureus
  MISC_FEATURE (1)..(397): hypothetical protein
MTKYFFSSSFLLFLGNWIGQIGLNWFVLTTYHNAVYLGIVNFCRLVPILLLSVWAGAIADKYDKGRLLRITISSSFLVTAILCVLTYSFTAIPISVIIIYATLRGILSAVETPLRQAILPDLSDKISTTQAVSFHSFIINICRSIGPAIAGVILAVYHAPTTFLAQAICYFIAVLLCLPLHFKVTKIPEDASRYMPLKVIIDYFKLHMEGRQIFITSLLIMATGFSYTTLLPVLTNKVFPGKSEIFGIAMTMCAIGGIIATLVLPKVLKYIGMVNMYYLSSFLFGIALLGVVFHNIVIMFICITLIGLFSQWARTTNRVYFQNNVKDYERGKVLSIIMMDRGMIPLGSLLMSICADVFGIVRTFSIMGISTICITMVFYFINRKLKLKLEESNHGIS

SEQ ID NO: 5339 - DNA, 216 bp, Staphylococcus aureus
atggctaaacaagatgtaattgaattagaaggtactgtattagatactttaccgaacgcaatgtttaaagtagaattagaaaatggtcatgagattttagctcacgtaagtggtaaaatcagaatgaattacattcgtattctacctggcgacaaagtaactgttgagatgtctccgtacgatttaacacgcggaagaattacttatcgttataaa

SEQ ID NO: 5340 - protein, 72 aa, Staphylococcus aureus
  MISC_FEATURE (1)..(72): translation initiation
MAKQDVIELEGTVLDTLPNAMFKVELENGHEILAHVSGKIRMNYIRILPGDKVTVEMSPYDLTRGRITYRYK

SEQ ID NO: 5341 - DNA, 1974 bp, Staphylococcus aureus
atgaacttgaacttaatttttaaagaacagacattaaaatttaacaaagaagaacaagaaacatatttatttttacaacaacataatagcgattgggctaatatttttaaagagatgattttacaaggaagagataaagtcactcagagattggtcacatcaatgcatcgcgaaaacttagttaaagcgcgcactcaaagtaagaaaatattgagtcgtgatttgattatgttagatatctcaacgactcatatactagaaatccagttcccacaagctaagcaaacattatatgctcctatcactggagaacacgcctttgatcgaattgatgttgaaggccctttctacattaaagatgacattacaaatacgattacacgagtacaccatccaaatgaaattcttgagtgtattttaattgaagcaccagatttaaaaaatgctgctagtgatcaatttcagcaagatttaataaacagtgcaactaatatgacatttgcaattagctatcaagcactgtcaatgcaacatgattctgcacctttatttaatattatcgaaaatagcgaagatagttacttgcgttcagagcaagccgttattgaaggtcatccgctacatcctggggctaaattacgtaaaggtttaaatgcattacaaacattcctatattcttcagaattcaatcaacctattaagttgaaaatagtactgattcacagtaaattaagccgtactatgtcactgtctaaagattatgatacaactgttcatcaactatttccggacttaattaaacaattagaaaatgaatttacgccaaagtttaactttaatgattatcacattatgattgttcatccatggcaattagatgacgtattacattctgattatcaagcagaagtagataaagaattaatcattgaagcaaaacatacgttggattattatgctggtttatctttcagaacattagttcctaaatacccagctatgtcgccacacatcaaattgtcgacaaacgttcatattacaggtgagattcgtacattatcagaacaaacgacgcacaatggtccactaatgacacgtattttaaatgatattttggagaaagatgtcatatttaagtcctatgcatcaacaattattgatgaagttgctggtattcatttttataatgagcaagacgaagcagactatcaaactgaacgaagtgaacaattaggtacattatttagaaaaaatatataccaaatgattccacaagaagtcacaccattgattccttcaagcttagttgcaacctacccatttaacaatgaatcacctatcgtgacattgattaaacgttatcaatcagctgcatcattgtctgattttgaatcatcggcgaaatcgtgggttgaaacttatagtaaagcattgcttggtctcgtaatcccactagttactaaatatggcattgcattagaggctcacttgcaaaatgctattgcaacatttcggaaagatggtctattggacacgatgtatattagagactttgaaggtttaagaattgataaagcacaactaaatgaaatggtatacagtacatctcatttccatgaaaaatcaagaattcttactgattcaaaaacgtctgtgtttaacaaagccttttattctaccgttcaaaaccatttaggcgaattaattcttacaatctctaaagcatcaaatgattcaaacttagaaagacatatgtggtatatcgttcgtgatgtactagataacatttttgatcaacttgtactttcgacacacaaatctaatcaagtaaatgagaatcgcataaatgaaattaaagataccatgttcgcgccatttatagattataagtgtgttacaacaatgcgtcttgaagatgaggcacatcattatacttatattaaagttaataaccctttgtatcgagaaaataat

SEQ ID NO: 5342 - protein, 658 aa, Staphylococcus aureus
  MISC_FEATURE (1)..(658): hypothetical protein
MNLNLIFKEQTLKFNKEEQETYLFLQQHNSDWANIFKEMILQGRDKVTQRLVTSMHRENLVKARTQSKKILSRDLIMLDISTTHILEIQFPQAKQTLYAPITGEHAFDRIDVEGPFYIKDDITNTITRVHHPNEILECILIEAPDLKNAASDQFQQDLINSATNMTFAISYQALSMQHDSAPLFNIIENSEDSYLRSEQAVIEGHPLHPGAKLRKGLNALQTFLYSSEFNQPIKLKIVLIHSKLSRTMSLSKDYDTTVHQLFPDLIKQLENEFTPKFNFNDYHIMIVHPWQLDDVLHSDYQAEVDKELIIEAKHTLDYYAGLSFRTLVPKYPAMSPHIKLSTNVHITGEIRTLSEQTTHNGPLMTRILNDILEKDVIFKSYASTIIDEVAGIHFYNEQDEADYQTERSEQLGTLFRKNIYQMIPQEVTPLIPSSLVATYPFNNESPIVTLIKRYQSAASLSDFESSAKSWVETYSKALLGLVIPLVTKYGIALEAHLQNAIATFRKDGLLDTMYIRDFEGLRIDKAQLNEMVYSTSHFHEKSRILTDSKTSVFNKAFYSTVQNHLGELILTISKASNDSNLERHMWYIVRDVLDNIFDQLVLSTHKSNQVNENRINEIKDTMFAPFIDYKCVTTMRLEDEAHHYTYIKVNNPLYRENN

SEQ ID NO: 5343 - DNA, 810 bp, Staphylococcus aureus
atgaagtgccttatgtataaaaattataacttgatccaacttacactaccaatagaaacttctgttagaattcctcaaattgatatttcgcgatatgttaatgaaattgttgaaacgatacctgatagcgaattcgataaattcagacatcatcgtggcgcaacatcctatcatccaaaaatgatgttaaaaatcaccttatatgcatatactcaatctgtattttctggtcgtagaatagagaaattacttcatgacagtattcgaatgatgtggttagctcaaaatcaaacaccttcttataaaactattaatcgtattagagtgaatcctaatactgatgcgttaattgaatctttatttatccagtttcatagtcaatgtttaaagcaaaatcttattgatggtacaaaagtagaagctaatgccaataggtatacatttgtgtggaagaaaagtattcaaaatcacgaatcgaaattgaacgaaaattcaaaaacattatatcgtgacttagttgaagaaaaaataataccagagataaaagaagatggagatagcgatttaacaatagaagaaatagatttaattggtagtcatttagataaagaaatcgaaggtttaaatcattctattgagaacgaagatagtactcaaattagaaaacagacccgtaaaaaagaactaagattaagaagttcaaaaataaatttgatgattattccgaaagaaaaaataaatatgaagaacaaaaatcgattcttaaagatagaaatagcttttctaaaactgatcatgatgcaactttta

SEQ ID NO: 5344 - protein, 270 aa, Staphylococcus aureus
  MISC_FEATURE (1)..(270): truncated transposase
MKCLMYKNYNLIQLTLPIETSVRIPQIDISRYVNEIVETIPDSEFDKFRHHRGATSYHPKMMLKITLYAYTQSVFSGRRIEKLLHDSIRMMWLAQNQTPSYKTINRIRVNPNTDALIESLFIQFHSQCLKQNLIDGTKVEANANRYTFVWKKSIQNHESKLNENSKTLYRDLVEEKIIPEIKEDGDSDLTIEEIDLIGSHLDKEIEGLNHSIENEDSTQIRKQTRKKELRLRSSKINLMIIPKEKINMKNKNRFLKIEIAFLKLIMMQLL

SEQ ID NO: 5345 - DNA, 312 bp, Staphylococcus aureus
atgaaggaagaccatatgaaaaatggccaacttaagccaggatacaatttacaaatagcgacaaattctcaatttgttttatcctatgacctatttcaaaacccaacagatactagaactttaattccatttttaacaatgattcaaaataccttcggttatttaccggagtatattgtagctgatgcaggttatggtagtgagcaaaactatatggctattatagatgattttaataaaacgccacttattacgtatggcatgtttattaaagataaaactagaaagtttaaaagtgacattttcaacact

SEQ ID NO: 5346 - protein, 104 aa, Staphylococcus aureus
  MISC_FEATURE (1)..(104): truncated transposase
MKEDHMKNGQLKPGYNLQIATNSQFVLSYDLFQNPTDTRTLIPFLTMIQNTFGYLPEYIVADAGYGSEQNYMAIIDDFNKTPLITYGMFIKDKTRKFKSDIFNT

SEQ ID NO: 5347 - DNA, 309 bp, Staphylococcus aureus
atgaagaattataattgggaatactttaaagtccaaattaatcaaaagctttctgaaccagaaacgaaaaaaatctatagtcaaagaaaaattgatgtagagcctgtttttggatttatgaaggctattttgggtttcactcgaatgtcagttcgaggaataaataaagttaaacgagagctaggttttgtattaatggcacttaatataaggaaaatagcagctcaacgagctgtacattataaaatacatatcaaaaaagctgatttctatcaaataattaatagaaatcagcttttttacattgcc

SEQ ID NO: 5348 - protein, 103 aa, Staphylococcus aureus
  MISC_FEATURE (1)..(103): truncated transposase
MKNYNWEYFKVQINQKLSEPETKKIYSQRKIDVEPVFGFMKAILGFTRMSVRGINKVKRELGFVLMALNIRKIAAQRAVHYKIHIKKADFYQIINRNQLFYIA

SEQ ID NO: 5349 - DNA, 507 bp, Staphylococcus aureus
atgactgtagataacaataaagcaaaacaagcatacgacaatcaaactggtgttaacgaaaaagaaagagaagagcgtcaaaaacaacaagaacaaaatcaggagcctcaattcaaaaacaaattaacattctctgatgaagttgttgaaaaaattgctggtatcgctgcacgtgaagttaaaggtatcttagatatgaaaggtggcttaactgatacattcactaatgcattctcaagtggcaacaatgttactcaaggtgtatctgttgaagttggtgaaaaacaagctgctgtagacttaaaagtaatcttagaatatggtgaatcagcaccaaaaatcttccgtaaagtaactgaattagttaaagaacaagttaaatatattactggtttagatgtagttgaagttaacatgcaagttgacgatgtaatgactcaaaaagagtggaaacaaaaacacgaaaaaaataacgaaaacaataaccaagaaagacaaggtttacaa

SEQ ID NO: 5350 - protein, 169 aa, Staphylococcus aureus [sequence omitted]

SEQ ID NO: 5351 - DNA, 237 bp, Staphylococcus aureus
atggctaacaatcataaccaaaacggacaagactctacacaacaagtgattaattttttaaaagtatttaaatggagaatcgttggtttcctagcgtttctattaatcgcgatattattcttaacgttaggtttttggaaaacagtacttatcatcgttttatgtttaattggtgtaggtattgggtatatgaaagaccgtaagcaagattttatgaattttttaaatcgatggagt

SEQ ID NO: 5352 - protein, 79 aa, Staphylococcus aureus
  MISC_FEATURE (1)..(79): hypothetical protein
MANNHNQNGQDSTQQVINFLKVFKWRIVGFLAFLLIAILFLTLGFWKTVLIIVLCLIGVGIGYMKDRKQDFMNFLNRWS

SEQ ID NO: 5353 - DNA, 546 bp, Staphylococcus aureus
gtgtcgttaggggtgaaacgacttaaaaactttatccttggcttattaatagtagtaatcgtggggttcctgttattcatgtatatccaagatggacgtataactgaatatcaagactacttccttcaatttgaatggttccaaccattacttatttcacttgctgcactattgatattaataggtcttatattagtatttagtatcttcaaacctacgcatcgaaaacctggattatacaaagacttcgatgatggtcatgtttacgtatctcgtaaagctgttgaaaagacggcattcgatacggttgcaaaatatgatcaagtaagacaaccaaatgtagttgcgaaactatataacaaaaaaaataaatcttatatcgacattaaaactgactttttcgtaccaaataatgttcaagttcaatctttaactgaagcaattcgttcggatattaaaaagaatgtagaatatttcacagaaatgccagtacgtaagttagaagttaatgtgagagatcagaaaacttctggtccacgagtgttg

SEQ ID NO: 5354 - protein, 182 aa, Staphylococcus aureus
  MISC_FEATURE (1)..(182): hypothetical protein
VSLGVKRLKNFILGLLIVVIVGFLLFMYIQDGRITEYQDYFLQFEWFQPLLISLAALLILIGLILVFSIFKPTHRKPGLYKDFDDGHVYVSRKAVEKTAFDTVAKYDQVRQPNVVAKLYNKKNKSYIDIKTDFFVPNNVQVQSLTEAIRSDIKKNVEYFTEMPVRKLEVNVRDQKTSGPRVL

SEQ ID NO: 5355 - DNA, 1560 bp, Staphylococcus aureus
atgaaaaataaatcagtaagtctagtgttttgggtatctttagtgatatgtacgatatttgttgcttttggagcaatatttccgaaacagttagaaaaactcacgcaaaacattactacatttattgcgctacatttttcttggtattatttattgctcgttttagttattttatttgtctgtgtgtatattttattttcgagatacgcaaacattacattaggtgaagaaggcgaagatcctgaattctcattgccgtcttggtttgctatgttatttagtgctggtatgggaataggacttgtgttctggacaacggcagaaccaatcagtcatgccttcaaattaacgcctattcataaagctggcacgcaatctgcaattaatgatgcaatgcagttttcatttttccattgggggattcatgcatgggcagtctatggtattgtcgcgctagtgtttgcatattttagctttcataaaggatatcctggcttagtcagcgctacattgacgcctttattaggtgaaaaggcaatgcgtggacctttaggtggtgccattgatgtattggcagtcatagctacagtaacaggcgttgctgcaacattaggtttcggtgcattgcaaataaacgaaggtttacattttttatttaatgtaccgagtaacttcacgatgcaagtaatcttgattgtcattgcaaccatattatttacttggtcagcatggtcaggtatcgataaaggtatcaaaacgttgagtaatatcaacatgttacttgcttttgtagtacttattggtctttttattgttgggccaacgctatacattttaaatacatttacgaatggtctaggtaattatattgcaaatttctttagtatgagtttacgcattccgacaggtggtcaaaaattccaatggttacaaaattggacaatcttttactgggcatggtggatatcttgggcaccatttgtaggtatatttattgcacgtgtgtcaaaaggacgtacgattaaagaatttattctaggtgtactttttgtcccggcgttagtttgctttatattctttgcggtattcggcgcgtcagcaatttacttacaagataatcatattgccgatattgctaaagctgcgacagaaacagcaacttttgcgacgctacaacattatccgctaggttttgtattaagcttaattactttacttgttattatgattttctttgttacatcagcggattcggcaacttatgttttaggtatgttgagttcaagtggtgatattaatccgaagtcatttgtcaaagtgagttggggtatcattatggcattatttgcaatcatcatgatttacacaggtggtactcaagcaattcaaaatttattaatcattgctgcgttaccattttccgtggtcattatagcgatgatatggtcgcttataaaatctttgagtgaggagaaaccgagaaatagtaataaggttttaattaaacatcgtgacccagatattttagaatatcgttcttcaaaacatattgacgaaaat

SEQ ID NO: 5356 - protein, 520 aa, Staphylococcus aureus
  MISC_FEATURE (1)..(520): glycine betaine transporter
MKNKSVSLVFWVSLVICTIFVAFGAIFPKQLEKLTQNITTFIALHFSWYYLLLVLVILFVCVYILFSRYANITLGEEGEDPEFSLPSWFAMLFSAGMGIGLVFWTTAEPISHAFKLTPIHKAGTQSAINDAMQFSFFHWGIHAWAVYGIVALVFAYFSFHKGYPGLVSATLTPLLGEKAMRGPLGGAIDVLAVIATVTGVAATLGFGALQINEGLHFLFNVPSNFTMQVILIVIATILFTWSAWSGIDKGIKTLSNINMLLAFVVLIGLFIVGPTLYILNTFTNGLGNYIANFFSMSLRIPTGGQKFQWLQNWTIFYWAWWISWAPFVGIFIARVSKGRTIKEFILGVLFVPALVCFIFFAVFGASAIYLQDNHIADIAKAATETATFATLQHYPLGFVLSLITLLVIMIFFVTSADSATYVLGMLSSSGDINPKSFVKVSWGIIMALFAIIMIYTGGTQAIQNLLIIAALPFSVVIIAMIWSLIKSLSEEKPRNSNKVLIKHRDPDILEYRSSKHIDEN

SEQ ID NO: 5357 - DNA, 999 bp, Staphylococcus aureus
atgaaaatgataggatttgagaagccctttaaattggaagaaggaaatttatttaaagtatacgaacaaagaaagccaacgccagaaaacgatgatatcttagtcaaagtaaatagcattagtgtaaatcctgtagatacaaagcaacgacaaatggaagtcactcaagcacctcgtgtacttgggtttgatgctattggtactgttgaagctatcggaccagacgttacattatttagtccgggtgacgttgtattttatgctggatcgccaaatagacaaggatcaaatgcgacatatcaattggtgtcagaagctatagttgcaaaagcaccacacaacataagtgctaatgaagcggttagtctaccgctaactggtattacggcatatgaaacgttttttgatacatttaaaatttctacgaatcctgctgaaaacgaagggaagtctgtcttaatcattaatggtgccggtggtgtaggcagtatagccactcaaattgctaaacggtatggtttaactgtcattacaacagcatcacgacaagaaacaacagagtggtgtgaaaagatgggcgcagatatcgtattgaatcataaagaggatttagtgcgtcaatttaaagaaattccattagtagattatatattttgcacctataatacagacttgtattacaatactatgattgaactgataaaaccattagggcatattacgactatcgtagcttttaatgaagatcaagatttaaatgcattaaaattaaaaagtataacatttacacatgaatttatgtttgcgcgtccaattcatcgaacgcctgatatgattaaacaacatgagtatttagaagatattacgaaaaatatagaatcagggcattaccaaccaacaacgacacaagtttttgaaggtttatcacctgaaaacttatatcaagcacatcaattgttggaaaaacaatcaatgattggaaaattagtaattaatata

SEQ ID NO: 5358 - protein, 333 aa, Staphylococcus aureus
  MISC_FEATURE (1)..(333): hypothetical protein
MKMIGFEKPFKLEEGNLFKVYEQRKPTPENDDILVKVNSISVNPVDTKQRQMEVTQAPRVLGFDAIGTVEAIGPDVTLFSPGDVVFYAGSPNRQGSNATYQLVSEAIVAKAPHNISANEAVSLPLTGITAYETFFDTFKISTNPAENEGKSVLIINGAGGVGSIATQIAKRYGLTVITTASRQETTEWCEKMGADIVLNHKEDLVRQFKEIPLVDYIFCTYNTDLYYNTMIELIKPLGHITTIVAFNEDQDLNALKLKSITFTHEFMFARPIHRTPDMIKQHEYLEDITKNIESGHYQPTTTQVFEGLSPENLYQAHQLLEKQSMIGKLVINI

SEQ ID NO: 5359 - DNA, 675 bp, Staphylococcus aureus
ttggtggtagataattttaggagggcacttatgaatatcattttgatgggtttacctggcgcaggtaaaggaactcaagcaagtgaaattgtcaagaaattcccaataccccacatttcaactggtgacatgttcagaaaagctataaaagaagaaactgaattaggtaaagaagctaagtcttatatggaccgtggcgaattagttcctgatgaagtgactgtaggtatcgttaaggaaagaatttctgaagacgatgcaaaaaaaggctttttattagatggcttcccaagaacaatcgagcaagctgaggcattaaataatattatgtctgagcttgacagaaacattgatgctgtcatcaatatcgaagttccggaagaagaattaatgaaccgtcttacaggtcgtcgaatctgtgagtcatgtggtacaacgtatcatcttgtatttaatcctccgaaggtcgaaggtatttgtgatatcgatggtggtaaattgtatcaacgagaagatgataatcctgaaacggtagctaatcgtttgagtgttaatattaaacaatctaagcctattttagatttctatgatcaaaaaggtgtattgaaaaatattgatggttcaaaagatattagcgacgttaccaaagatgtcattgatattttagatcatttg

SEQ ID NO: 5360 - protein, 225 aa, Staphylococcus aureus
  MISC_FEATURE (1)..(225): adenylate kinase
LVVDNFRRALMNIILMGLPGAGKGTQASEIVKKFPIPHISTGDMFRKAIKEETELGKEAKSYMDRGELVPDEVTVGIVKERISEDDAKKGFLLDGFPRTIEQAEALNNIMSELDRNIDAVINIEVPEEELMNRLTGRRICESCGTTYHLVFNPPKVEGICDIDGGKLYQREDDNPETVANRLSVNIKQSKPILDFYDQKGVLKNIDGSKDISDVTKDVIDILDHL

SEQ ID NO: 5361 - DNA, 1002 bp, Staphylococcus aureus
atgatgcaaaataaacaaattctttttaacaaaataccagaaggcatgcctcaagaggatacattcaaaattgaagagattgacacgcctaaacttgagagcgatggtgtacttgtacaaacgctgtatatttcagtggatccatatatgagaggacgtatgactaaggcagattcgtatgtacagccttttgaaattggtaaaccgattgttagccatgtcgttgcaaaagtaattgattcgacactcgcagattataaaaaaggagatgtcgttgtaggtatgttgccttggcgaatcattaatcatgtccaagcggatcaaattactaaagttccaacgacagatgtaccacttgatttatatttaagtgttttaggaatgccaggacaaacagcatatcatggtctgcttgatattggacaacctaaagccggtgatactgttgtggtttcagctgcatctggtgctgtaggttcagttgtaggtcaaattgctaagattaaaggttgccgtgtagtaggtattgcgggtggcgacaaaaaagtaaattatttaacagagacactgggctttgacgctggtattgattataagaaagaggattttgcagaagcgttagcacaagcagtaccagatggtattgatgtttattttgaaaatgttggtggaacagttggcgatgaagtatttaagcatttaaatcgttttgcacgtgtaccagtatgtggcgcaatttcgtcatataatcatcctgaagccgatatcggaccacgtattcaaggtacgcttattaagaagcaagtaatgatgagaggcttcttggtaagtgaattcgctaatgcttttaaagaagctagtgaacagcttgcaacatgggttcaagaaggtaaaattcagtcacaagtaaccattgaagatggttttgaaaatgcgccacatgcatttaaaaatttatttactggcgataactttggtaaacaagttattaaagtaacggaa

SEQ ID NO: 5362 - protein, 334 aa, Staphylococcus aureus
  MISC_FEATURE (1)..(334): hypothetical protein
MMQNKQILFNKIPEGMPQEDTFKIEEIDTPKLESDGVLVQTLYISVDPYMRGRMTKADSYVQPFEIGKPIVSHVVAKVIDSTLADYKKGDVVVGMLPWRIINHVQADQITKVPTTDVPLDLYLSVLGMPGQTAYHGLLDIGQPKAGDTVVVSAASGAVGSVVGQIAKIKGCRVVGIAGGDKKVNYLTETLGFDAGIDYKKEDFAEALAQAVPDGIDVYFENVGGTVGDEVFKHLNRFARVPVCGAISSYNHPEADIGPRIQGTLIKKQVMMRGFLVSEFANAFKEASEQLATWVQEGKIQSQVTIEDGFENAPHAFKNLFTGDNFGKQVIKVTE

SEQ ID NO: 5363 - DNA, 882 bp, Staphylococcus aureus
atgggagttaaaagtgtgaagaaaatttttgtaattattacgacattgttagcggtcgctattattataggctctattattatggtggtgtttagtcaacgacaggcacaaacatttaaaatacaacaacagcaatttgttaaaaagccaattccaacattgttcttacatggatttggtggtagtgccaattctgaaaagtttatggtgaagcaagcagaaaaaagaggggtaactaaagatatcatcactgcttacgtttcaaaggatggtgcagtgacatttaaagggaaactaagaaaagatgcagtgaatcctattgtgaaaattgaacttgaaaataacagacaaggctatttggataagaatgctgcgtggtttaaaaatgtactgactaagttacaatctgaatacaatttcgataaattcaactttgtcggtcactcaatggggaacttaacatttgcacaatatatgatgacatatggtaacgacaagtcactgccacagttaaacaaacaagtgaatattgcagggacatttaatggtgttttaaatatgaatgaagatgtcaatgaaattacagttgataaagatggtaaaccaagtcgaatgaatcaaccttatcagcaattacgcgtgctaaaagatatttataaaggtaaaggtatcgaagtgctaaatatttatggggatttgaaagatggtacacattcagacggcagagtgtctaatagttcttcgaaatcattaaaatatttactgggaaatagtccgaaaagttatcgagaatctaaatatgaaggtgagcctgcacaacatagtcagcttcatgagaatgaaaatgttgctaatgagttaatcgacttcttatggaaaaaa

SEQ ID NO: 5364 - protein, 294 aa, Staphylococcus aureus
  MISC_FEATURE (1)..(294): conserved hypothetical
MGVKSVKKIFVIITTLLAVAIIIGSIIMVVFSQRQAQTFKIQQQQFVKKPIPTLFLHGFGGSANSEKFMVKQAEKRGVTKDIITAYVSKDGAVTFKGKLRKDAVNPIVKIELENNRQGYLDKNAAWFKNVLTKLQSEYNFDKFNFVGHSMGNLTFAQYMMTYGNDKSLPQLNKQVNIAGTFNGVLNMNEDVNEITVDKDGKPSRMNQPYQQLRVLKDIYKGKGIEVLNIYGDLKDGTHSDGRVSNSSSKSLKYLLGNSPKSYRESKYEGEPAQHSQLHENENVANELIDFLWKK

SEQ ID NO: 5365 - DNA, 1410 bp, Staphylococcus aureus
atgactaaaacattacctgaagattttatttttggtggagcaacagcagcatatcaagcagaaggtgcgacaaatacggatggtaaaggtcgcgtagcatgggatacgtatttagaagaaaactattggtacactgcagaaccagcgagtgatttttataacagatatccagtggatttagaattaagtgaaaaattcggtgttaatggtatccgaatttcaattgcatggtctcgtatcttcccaaatggatatggcgaagttaaccctaaaggtgttgagtattaccataagttatttgcagagtgtcataaacgtcatgttgaaccatttgtaacattgcatcattttgatacaccagaagtgttacacaaagatggcgattttctaaatcgtaaaacgattgactactttgtagattatgctgaatattgttttaaagaattcccagaagtaaaatattggactacattcaatgaaattggacctattggtgatggtcaatatttagtaggtaaattccctccaggtattaaatatgattttgaaaaagtattccaatcacatcataacatgatggtggctcatgctagagcagtaaaattatttaaagatggcggatacaaaggagaaattggtgttgtacacgcattgccaacaaaatatccgttcgatccatcaaatcctgaagatgttcgtgcagcagaattagaagatatcatccataataaattcatcttagatgcaacatatttaggtaagtattctcgtgaaacgatggaaggtgtgcaacatatcttatctgttaatggcggtaaattaaacattacagatgaagattatgccattttagatgcagccaaagatttaaacgacttcttaggtatcaattactacatgagtgattggatgagaggttacgatggagaatctgaaatcacgcataatgcgacaggtgataaaggcggttctaaataccaacttaaaggtgtcggacaacgtgaatttgatgtcgacgtacctcgcacagactgggactggatgatctatcctcaaggtttatatgatcaaatcatgcgtgttgttaaagattatcctaactatcataagatttatatcactgaaaatggtttaggatataaagatgaatttattgaatctgaaaaaacagttcatgatgatgcacgtattgattatgtaagacaacatttgaacgttattgcagatgctattatagatggtgcaaatgttaaaggttactttatttggtcattaatggatgtgttctcttggtcaaatggttatgaaaaacgatatggtttattctatgtcgattttgagactcaagaacgttatcctaagaaaagtgcttattggtacaaagagttagccgaaacaaaagaaattaaa

SEQ ID NO: 5366 - protein, 470 aa, Staphylococcus aureus
MTKTLPEDFIFGGATAAYQAEGATNTDGKGRVAWDTYLEENYWYTAEPASDFYNRYPVDLELSEKFGVNGIRISIAWSRIFPNGYGEVNPKGVEYYHKLFAECHKRHVEPFVTLHHFDTPEVLHKDGDFLNRKTIDYFVDYAEYCFKEFPEVKYWTTFNEIGPIGDGQYLVGKFPPGIKYDFEKVFQSHHNMMVAHARAVKLFKDGGYKGEIGVVHALPTKYPFDPSNPEDVRAAELEDIIHNKFILDATYLGKYSRETMEGVQHILSVNGGKLNITDEDYAILDAAKDLNDFLGINYYMSDWMRGYDGESEITHNATGDKGGSKYQLKGVGQREFDVDVPRTDWDWMIYPQGLYDQIMRVVKDYPNYHKIYITENGLGYKDEFIESEKTVHDDARIDYVRQHLNVIADAIIDGANVKGYFIWSLMDVFSWSNGYEKRYGLFYVDFETQERYPKKSAYWYKELAETKEIK

SEQ ID NO: 5367 - DNA, 1719 bp, Staphylococcus aureus
gtgatgacaatgatgcaaaaattgatcgcacaaattgaaaaagggaagccatttttcgagaaattatcacgtaacatatatttaagagccatccgtgatggatttatttctgcaatgcctgtcatcttattctcaagtatctttctattaattgcatatgtgccaaatatatttggttttaaatgggataaaggcatggaagccattttaatgaaaccatataactatacgatggggcttgtagcatttttagtagcaggaacgacagcgaaatctttaacagattcatttaaccgtaagctagaaagtacaaatcaaattaactttatttctacaatgctagcagcgatgtgtggattcttgttcttagcttctgatccagccaaagatggtggattcttaagtgcatttatgggaactaaaggtttattaacagcattcttatcagcatttgtaactgttattgtttataacttctgtgtgaagcgcaatattacaattaaaatgccgaaagaagtaccgccgaatatttcacaagtatttaaggacttaattccattttcagcggtaatcatcattctttatgcattagatttagtcattcgcaacagctttaaatcaaatgtagcggaaggtattttaaaattattcgaaccattatttacagcagcagatggatggattggtgtcacaattatctttggtgcctttgcattattctggtttgtaggtattcatggtccgtcaattgtagagccagcaattgcagccattacatatgcgaatatcgaagcgaacttcaagttgcttcaagctggagaacacgcagataaaattattacatcaggtacacaaatgtttatcgttacatttggaggtacgggtgcaacattggtcgtcccgttcatgtttatgtggatgacgaaatctaaacgaaacaaagcgattggacgtgcatcagttgtaccaacattctttggtgtaaacgaaccaattttatttggtgcaccactagtattgaatcctgtgttctttattccatttgtattagcaccaattgttaacgtatggattttcaaacttttcgttgaagtgttaggaatgaatagttttagtgtgaatttaccttggacaacaccaggtccattgggcattatcatgggtacaggttttggtttatggtcattcgtactagctattactttgattgttgtagatattattatttactacccattcctaaaagtttatgatagtgaaattcttgatgaagaagaaggacgtaaagaaagtaattcagatttaaaagaaaaagttgcagcaaactttgatacgaaaaaagctgattcaattttagcggcaagtggtgtatcagacgatgcagctaaagcttcaaatatcacagaacaaacaaatgtcttagtactttgtgccggtggtggtacaagtggattattagccaatgcacttaataaagcagctgaagaatatcatgtgccagtgaaagcggcagctggcggatatggcgcacatatggacattatgaaagagtaccaattaatcattttagcgccacaagttgcgtctaactatgaagatattaagcaagatacagatagattaggtattaaattagcgaagactcaaggtgctgaatatatcaaattgacacgagatggccaagcagcccttgatttcgttcaacaacaatttgaaaat

SEQ ID NO: 5368 - protein, 573 aa, Staphylococcus aureus
  MISC_FEATURE (1)..(573): PTS system,
VMTMMQKLIAQIEKGKPFFEKLSRNIYLRAIRDGFISAMPVILFSSIFLLIAYVPNIFGFKWDKGMEAILMKPYNYTMGLVAFLVAGTTAKSLTDSFNRKLESTNQINFISTMLAAMCGFLFLASDPAKDGGFLSAFMGTKGLLTAFLSAFVTVIVYNFCVKRNITIKMPKEVPPNISQVFKDLIPFSAVIIILYALDLVIRNSFKSNVAEGILKLFEPLFTAADGWIGVTIIFGAFALFWFVGIHGPSIVEPAIAAITYANIEANFKLLQAGEHADKIITSGTQMFIVTFGGTGATLVVPFMFMWMTKSKRNKAIGRASVVPTFFGVNEPILFGAPLVLNPVFFIPFVLAPIVNVWIFKLFVEVLGMNSFSVNLPWTTPGPLGIIMGTGFGLWSFVLAITLIVVDIIIYYPFLKVYDSEILDEEEGRKESNSDLKEKVAANFDTKKADSILAASGVSDDAAKASNITEQTNVLVLCAGGGTSGLLANALNKAAEEYHVPVKAAAGGYGAHMDIMKEYQLIILAPQVASNYEDIKQDTDRLGIKLAKTQGAEYIKLTRDGQAALDFVQQQFEN

SEQ ID NO: 5369 - DNA, 309 bp, Staphylococcus aureus
atgaatagagaagaagtccaattattaggttttgaaattgttgcatttgcaggggatgcacgttctaagtttttagaagcattaacagcagctcaagctggagattttgcaaaagcagatgcactgattgaagaaggaaacaattgcattgcggaagcgcatagagcacaaacaagcctgttggctaaagaagcgcaaggtgatgatattgcatacagtgtaacgatgatgcatggtcaagatcatttaatgacaacaattttactgaaagatttaatgaagcatttattagaattttataaaagaggg

SEQ ID NO: 5370 - protein, 103 aa, Staphylococcus aureus
  MISC_FEATURE (1)..(103): PTS system,
MNREEVQLLGFEIVAFAGDARSKFLEALTAAQAGDFAKADALIEEGNNCIAEAHRAQTSLLAKEAQGDDIAYSVTMMHGQDHLMTTILLKDLMKHLLEFYKRG

SEQ ID NO: 5371 - DNA, 978 bp, Staphylococcus aureus
atgtcaaaatcgaatcaaaaaatcgcatcaattgaacaattaagtaacaacgaaggtatcatttctgcattagcatttgaccaacgtggtgctttaaaacgcatgatggcaaaacatcaaactgaagaaccaactgtagctcaaattgaacaattaaaagtattagttgcggaagaattaacacaatatgcatcttcaattttattagatcctgaatatggtttaccagcttcagatgcacgtaacaaagattgtggattattacttgcttatgaaaaaactggatatgacgtaaacgctaaaggtcgtttacctgactgtttagtagagtggtctgcaaaacgtttaaaagaacaaggcgcaaatgctgttaaattcttactttactatgatgttgatgatgctgaagaaattaacattcaaaagaaagcatacattgaaagaatcggttcagaatgtgttgcagaagatattccattctttttagaagtattaacatacgatgacaacattcctgataacggtagtgttgaattcgcaaaagttaagcctagaaaggttaacgaagcaatgaaattattctcagaaccacgctttaacgttgatgtattgaaagttgaagtaccagtaaacatgaaatatgtagaaggctttgctgaaggtgaagtggtttatacaaaagaggaagcggcacaacactttaaagatcaagatgcagcaactcatttaccatacatttacttaagtgctggtgtttctgcggaattattccaagaaactttaaaatttgctcacgaagctggtgctaaattcaacggggtactttgtggccgtgctacatggtctggtgctgttcaagtatacattgaacaaggtgaagatgctgctcgtgaatggttacgtacaactggtttcaaaaatattgatgacttaaataaagtattaaaagatactgcgacatcttggaaacaaagaaaa

SEQ ID NO: 5372 - protein, 326 aa, Staphylococcus aureus
  MISC_FEATURE (1)..(326): tagatose 1,6-diphosphate
MSKSNQKIASIEQLSNNEGIISALAFDQRGALKRMMAKHQTEEPTVAQIEQLKVLVAEELTQYASSILLDPEYGLPASDARNKDCGLLLAYEKTGYDVNAKGRLPDCLVEWSAKRLKEQGANAVKFLLYYDVDDAEEINIQKKAYIERIGSECVAEDIPFFLEVLTYDDNIPDNGSVEFAKVKPRKVNEAMKLFSEPRFNVDVLKVEVPVNMKYVEGFAEGEVVYTKEEAAQHFKDQDAATHLPYIYLSAGVSAELFQETLKFAHEAGAKFNGVLCGRATWSGAVQVYIEQGEDAAREWLRTTGFKNIDDLNKVLKDTATSWKQRK

SEQ ID NO: 5373 - DNA, 930 bp, Staphylococcus aureus
atgattttaactttaacattaaatccatccgttgatatttcatacccattaacagcattgaaattagatgatgttaatcgtgttcaagaagtaagtaaaacagctggtggtaaaggtttaaatgtaacaagagtacttgcgcaagtaggtgagccagtccttgcgagtggttttattggcggtgaattaggtcaatttattgctaaaaaattagatcatgccgacatcaagcatgcattttataacattaagggtgaaacacgaaactgcattgcaattttacatgaagggcaacaaacagaaattttagagcagggaccggagattgataatcaagaggctgcaggatttattaaacattttgaacaattattagaaaaagttgaagcagttgctatttcaggtagcttacctaaaggattaaatcaagattattatgcacaaatcattgaacgatgccaaaacaaaggtgtgcctgtgatattagattgctcgggtgcaactttgcaaacagttttggaaaatccatacaaacctacagtcattaaaccaaacatttctgaactatatcaattgcttaaccagccacttgatgaaagtttagaaagtttgaaacaggcagtgtcacaacccttattcgaagggattgagtggattattgtgtctttaggtgcacaaggtgcattcgctaagcacaatcatacattctatagagtgaatattccgacaataagtgtattaaatccggttggttcaggtgattctacagttgctggaattacttcagcaattcttaatcatgaaaacgaccacgatttactaaaaaaagccaatactttaggcatgctgaatgcacaagaagcacaaacaggttatgtcaatttaaataattatgatgatttattcaatcaaattgaagttttagaggtg

SEQ ID NO: 5374 - protein, 310 aa, Staphylococcus aureus
  MISC_FEATURE (1)..(310): tagatose-6-phosphate kinase
MILTLTLNPSVDISYPLTALKLDDVNRVQEVSKTAGGKGLNVTRVLAQVGEPVLASGFIGGELGQFIAKKLDHADIKHAFYNIKGETRNCIAILHEGQQTEILEQGPEIDNQEAAGFIKHFEQLLEKVEAVAISGSLPKGLNQDYYAQIIERCQNKGVPVILDCSGATLQTVLENPYKPTVIKPNISELYQLLNQPLDESLESLKQAVSQPLFEGIEWIIVSLGAQGAFAKHNHTFYRVNIPTISVLNPVGSGDSTVAGITSAILNHENDHDLLKKANTLGMLNAQEAQTGYVNLNNYDDLFNQIEVLEV

SEQ ID NO: 5375 - DNA, 513 bp, Staphylococcus aureus
atgaagattgcattaggatgcgaccatattgttacagatacaaaaatgcgtgtatctgaatttttaaaatcaaaaggacatgaagtcattgacgtaggaacatacgatttcacaagaacacattatccaatttttggtaaaaaagttggcgaacaagttgttagcggtaatgcagacttaggtgtttgtatttgtggaacaggtgttggtattaacaatgctgtaaataaagtacctggcgttcgttcagcactagtacgtgatatgacatcagcgttatacgctaaagaagaattaaatgcgaacgttattggcttcggtggacgtattataggtgagttattaatgtgcgatattatcgatgcatttattaatgctgaatataaaccaactgaagagaacaaaaaattaatcgctaaaattaaacatttagaaacaagcaatgcagatcaagctgatccacatttctttgatgaattcttagaaaaatgggacagaggcgaataccacgat

SEQ ID NO: 5376 - protein, 171 aa, Staphylococcus aureus
  MISC_FEATURE (1)..(171): galactose-6-phosphate
MKIALGCDHIVTDTKMRVSEFLKSKGHEVIDVGTYDFTRTHYPIFGKKVGEQVVSGNADLGVCICGTGVGINNAVNKVPGVRSALVRDMTSALYAKEELNANVIGFGGRIIGELLMCDIIDAFINAEYKPTEENKKLIAKIKHLETSNADQADPHFFDEFLEKWDRGEYHD

SEQ ID NO: 5377 - DNA, 426 bp, Staphylococcus aureus
atggcgattattattggttcagatgaagctggcaaacgattaaaagaagtcatcaaatcatacttattagacaataaatatgatgttgttgacgtaacagaaggacaggaagttgactttgttgatgcaactttggctgtagcaaaagatgttcaaagtcaagaaggtaacttaggtattgttatcgatgcatttggtgcaggtagctttatggttgctacaaaaatcaaaggcatgattgctgctgaagtatcagatgaacgctctggatatatgactagaggccataacaattcaagaatgatcactatgggatctgaaattgttggagacacattagcgaaaaatgtcgttaaaggttttgttgaaggtaaatacgatggtggtagacaccaaatccgcgtagatatgcttaataaaatgtgc

SEQ ID NO: 5378 - protein, 142 aa, Staphylococcus aureus
  MISC_FEATURE (1)..(142): galactose-6-phosphate
MAIIIGSDEAGKRLKEVIKSYLLDNKYDVVDVTEGQEVDFVDATLAVAKDVQSQEGNLGIVIDAFGAGSFMVATKIKGMIAAEVSDERSGYMTRGHNNSRMITMGSEIVGDTLAKNVVKGFVEGKYDGGRHQIRVDMLNKMC

SEQ ID NO: 5379 - DNA, 789 bp, Staphylococcus aureus
atgacccatcgcctaaataaaggaggcaattttacattgaataaacatgaacgtttggacgaaattgctaaactagtgaataaaaagggcacgataagaacgaatgaaatcgtcgaaggtttaaatgtgtctgatatgacagttcgaagagatttaattgaattggaaaataaagggattttaacgaagattcatggtggtgcacgcagtaattcaacatttcagtataaagaaatatcgcataaagaaaaacatacccgtcaaattgcagaaaaacgatttatagctaaaaaagctgcatcattaattgaagatggggatactttgtttttcggaccaggaacaacagtggaactattagcagaagaagtcaatcatcatacgctcacaattattacgaattgtttgccggtgtataaaattttgttagaaaaacaaacagcacattttcgtgtctatttaattggtggtgaaatgcgccatattacagaagcatttgtaggtgaaatggcgaacgccatgttggaaaaactaagatttagcaagatgttctttagtagtaacgcagtaaataaaggtgctgtgatgacatctacattagatgaagcctatacgcaacaactggcactaagtaattcaattgaaaaatacttgttaatcgatcatacgaaagttggcaaagaagattttacatcattttgtcagttaaacgaattgactgcagtggtcatggactatgaagatgaagaaaaagtagaaacgattaaaacatatattgaagtagtcgac

SEQ ID NO: 5380 - protein, 263 aa, Staphylococcus aureus
  MISC_FEATURE (1)..(263): lactose phosphotransferase
MTHRLNKGGNFTLNKHERLDEIAKLVNKKGTIRTNEIVEGLNVSDMTVRRDLIELENKGILTKIHGGARSNSTFQYKEISHKEKHTRQIAEKRFIAKKAASLIEDGDTLFFGPGTTVELLAEEVNHHTLTIITNCLPVYKILLEKQTAHFRVYLIGGEMRHITEAFVGEMANAMLEKLRFSKMFFSSNAVNKGAVMTSTLDEAYTQQLALSNSIEKYLLIDHTKVGKEDFTSFCQLNELTAVVMDYEDEEKVETIKTYIEVVD

SEQ ID NO: 5381 - DNA, 1290 bp, Staphylococcus aureus
atgattcaaacccttgtgaacttctttagaacaaaagaggttcgtaacaagattttcttcacactagcaatgttagtaatttttaaaatagggacttatataccagctccaggagtaaatcctgcagcttttgataatccccaaggttctcaaggtgccactgagttattaaatacttttggtggcggagccttgaaacgattttctatttttgcaatgggtattgtaccctacatcactgcatcaatcgtaatgcaattattacaaatggatattgtccctaaattctcagaatgggcaaaacaaggtgaagtaggtagaagaaagttaaataacgttactcgttatttagcaatttctttagcatttatccaatctataggtatggcattccaatttaataattatctcaaaggtgcgctgattatcaatcagtcaattatgagttatttattaatagcactagttttgacagcaggaactgctttcttaatatggcttggtgatcaaatcactcagttcggtgttggtaatggtatttctattatcatatttgcgggtattttatcaacgttgccagccagtctaattcaatttggacaaactgcgttcgttgggcaagaagatacatcattagcatggttgaaagtattaggacttttagtgtcactgatactattaactgtaggtgctatttatgtacttgaagccgttcgtaaaattccgattcaatatgctaagaaacaaactgctcaaagattaggttcacaggcaacttatctacctttaaaagtgaactcagccggtgttattcctgtaatctttgcaatggcgttcttcttactgcctagaacattaacgttgttctatccagataaagaatgggcacaaaacattgcgaatgctgcaaatccttcaagtaatgttggtatggttgtatatattgtactaattatactattcacatacttctatgcatttgtacaagttaatccggaaaaaatggctgataaccttaagaaacaaggtagctatgttccaggtattagacctggtgaacaaaccaaaaaatatattactaaagttttatatcgtttaacttttgtaggttctatcttcttagccgttatttcaattctaccgatattagcaactaagtttatgggattaccacaatcaattcagattggtggtacaagtttacttatcgttattggtgtagcgattgaaacaatgaaatctttagaagctcaagtatctcaaaaagaatataaaggctttggtggtaga

SEQ ID NO: 5382 - protein, 430 aa, Staphylococcus aureus
  MISC_FEATURE (1)..(430): preprotein translocase SecY
MIQTLVNFFRTKEVRNKIFFTLAMLVIFKIGTYIPAPGVNPAAFDNPQGSQGATELLNTFGGGALKRFSIFAMGIVPYITASIVMQLLQMDIVPKFSEWAKQGEVGRRKLNNVTRYLAISLAFIQSIGMAFQFNNYLKGALIINQSIMSYLLIALVLTAGTAFLIWLGDQITQFGVGNGISIIIFAGILSTLPASLIQFGQTAFVGQEDTSLAWLKVLGLLVSLILLTVGAIYVLEAVRKIPIQYAKKQTAQRLGSQATYLPLKVNSAGVIPVIFAMAFFLLPRTLTLFYPDKEWAQNIANAANPSSNVGMVVYIVLIILFTYFYAFVQVNPEKMADNLKKQGSYVPGIRPGEQTKKYITKVLYRLTFVGSIFLAVISILPILATKFMGLPQSIQIGGTSLLIVIGVAIETMKSLEAQVSQKEYKGFGGR

SEQ ID NO: 5383 - DNA, 738 bp, Staphylococcus aureus
gtgtttaacttgaaacatgatttagagacactaaaacatattatagatagttcgaatcgtattacattttttacaggtgctggtgtatctgtcgcaagtggcgttccagatttccgttcaatgggtggcttatttgatgaaatttcaaaagatgggctttcgccagaatacttgttaagccgtgattatttagaagatgatcctgaaggttttatcaatttctgccataagcgcttactatttgtcgatacgatgcccaatatcgttcatgattggattgcaaaattagaacgtaatcaacaatctttaggtgtcatcacgcaaaatatcgatggtttgcactcagacgctggaagtcaacatgttgatgaattacatggcacgttaaatcgtttttattgtaatgtatgtcataaatcttatacgaagtcagatgttattgatagaactttgaaacattgtgataattgtggtggtgccattcgaccggacatcgtattatacggtgaaatgttagatcaacctaccatcataagggcattaaataaaattgaacatgctgacacccttgttgtactaggttcatcactcgttgtacaacctgccgcaggattaatatcacattttaaaggcgacaatttaattattatcaataaagatcgaacaccttatgatagcgacgctactttggtcatacatgacgacatggtttccgttgtaaaatcattaatgacagag

SEQ ID NO: 5384 - protein, 246 aa, Staphylococcus aureus
  MISC_FEATURE (1)..(246): hypothetical protein
VFNLKHDLETLKHIIDSSNRITFFTGAGVSVASGVPDFRSMGGLFDEISKDGLSPEYLLSRDYLEDDPEGFINFCHKRLLFVDTMPNIVHDWIAKLERNQQSLGVITQNIDGLHSDAGSQHVDELHGTLNRFYCNVCHKSYTKSDVIDRTLKHCDNCGGAIRPDIVLYGEMLDQPTIIRALNKIEHADTLVVLGSSLVVQPAAGLISHFKGDNLIIINKDRTPYDSDATLVIHDDMVSVVKSLMTE

SEQ ID NO: 5385 - DNA, 606 bp, Staphylococcus aureus
atgtgctttgatataaataatttggatataaaaaagttgaattttagaaaggtaaaaaacgcaattcatttaagtttaagtggcgataaataccagtttttggaggacggtaaaactatcaataatacttattttttagctgtatatgataatgcaataaacatttttgaagatttgttttcgccttctgattctataaatttggttcatgtagtatatgtttatagtgaaccttataagaaaacaaatgttataaaaaaatttacatcgttaacaatagatgaattgtattactttaaagaatataaaaaggagaaggatgataatattttgtgcgaggagttttcatataagtgttccataaaagatataaaatataaaaaattattaaaagctatatccaatcaagactttaaagggttagttccaaatatcaatcagaatgataattattctgaaatatatataattaacaatactaaaaacttaatatatcatttatatgatgatagaggtctatggctagcttttaataataatgaagattatgcaagatattctgaaaaatataatgatttaatatcggaatttgataatgaagatatc

SEQ ID NO: 5386 - protein, 202 aa, Staphylococcus aureus
MCFDINNLDIKKLNFRKVKNAIHLSLSGDKYQFLEDGKTINNTYFLAVYDNAINIFEDLFSPSDSINLVHVVYVYSEPYKKTNVIKKFTSLTIDELYYFKEYKKEKDDNILCEEFSYKCSIKDIKYKKLLKAISNQDFKGLVPNINQNDNYSEIYIINNTKNLIYHLYDDRGLWLAFNNNEDYARYSEKYNDLISEFDNEDI

SEQ ID NO: 5387 - DNA, 123 bp, Staphylococcus aureus
atgagatatatacacttttctattattacattaattacaggtatcattatgcatattacaatgtactttgtaccatttgaatctcggaaaatgccactatttatgacgataatttttacaatc

SEQ ID NO: 5388 - protein, 41 aa, Staphylococcus aureus
  MISC_FEATURE (1)..(41): hypothetical protein
MRYIHFSIITLITGIIMHITMYFVPFESRKMPLFMTIIFTI

SEQ ID NO: 5389 - DNA, 846 bp, Staphylococcus aureus
atgaatcatattgaaataagtaaagatgtaaagataccagtattaggtttcggagtatttcaaattcctcaagaacaaacagcagaagcggttaaagaagcaattaaagcgggttatagacatattgatacagcacaaagttatttaaatgaaactgaagtaggtcaaggtattgaagcttcaggtattgatagaagtgaactattcattacgactaaagtatggattgaaaatgttaactatgaagatactatcaaatcaatcgaacgatcattacaacgattaaatttggactatcttgatctagtgcttattcaccaaccttacaatgacgtatatggctcatggcgtgcattagaagagttaaaagaaaatggtaaaattaaagcaatcggtgtatctaacttcggcgttgatcgaattgtagatttaggtattcacaatcaaattcaaccacaagtgaaccaaatagaaattaatccattccatcaacaagaagaacaagttgcagcacttcaacaagaaaatgttgtggtagaagcttgggcaccatttgcagaaggtaaaaatcaattattccaaaatcaattgttgcaggccattgcagataaatacaacaaatcaattgcacaagttattttacgctggttagtagaacgtgacattgttgtactcgcaaaatcagtaaatccagaacgtatggctcaaaacttagatatatttgattttgaacttacagaagaagataaacaacaaattgcgacattagaagaaagtaatagccaatttttctcacatgctgatccagagatgattaaagcacttacaagcagagaattagatgtt

SEQ ID NO: 5390 - protein, 282 aa, Staphylococcus aureus
  MISC_FEATURE (1)..(282): hypothetical protein
MNHIEISKDVKIPVLGFGVFQIPQEQTAEAVKEAIKAGYRHIDTAQSYLNETEVGQGIEASGIDRSELFITTKVWIENVNYEDTIKSIERSLQRLNLDYLDLVLIHQPYNDVYGSWRALEELKENGKIKAIGVSNFGVDRIVDLGIHNQIQPQVNQIEINPFHQQEEQVAALQQENVVVEAWAPFAEGKNQLFQNQLLQAIADKYNKSIAQVILRWLVERDIVVLAKSVNPERMAQNLDIFDFELTEEDKQQIATLEESNSQFFSHADPEMIKALTSRELDV

SEQ ID NO: 5391 - DNA, 414 bp, Staphylococcus aureus
atgaaaactaaagaagtcgtagcgctcatgaatatatctcaagacactttaagatattatgaaaaggttggtgtgattccaccagttaatcgagatgaaaatggatatagaatatataatgatagtgatttaaattggatttatttagtgaaaaatttgcgaaatgcaggcgtcagtattgaatcgcttatcgaattttgcaggttagcgcagcttcctaaaaatgaaaatattcaagcacagcaaaagcaaattttaaataagcaactcgaagaattaaatgaaaacttaaagacaattcatgatgcgagagatttactacaatataaaattgataattatgataatcatattgctaaaatcaatgctagtgataattatgatgacaatgttgaacgtctttgggagagaaag

SEQ ID NO: 5392 - protein, 138 aa, Staphylococcus aureus
  MISC_FEATURE (1)..(138): hypothetical protein
MKTKEVVALMNISQDTLRYYEKVGVIPPVNRDENGYRIYNDSDLNWIYLVKNLRNAGVSIESLIEFCRLAQLPKNENIQAQQKQILNKQLEELNENLKTIHDARDLLQYKIDNYDNHIAKINASDNYDDNVERLWERK

SEQ ID NO: 5393 - DNA, 2427 bp, Staphylococcus aureus
atgtcaatgacatatagaataaagaaatggcaaaaattatccaccattacgttattaatggctggtgtgattactttgaatggtggtgaattcagaagtgttgataaacatcaaatcgctgtggctgatacgaatgttcaaacgccagattatgaaaaattgaggaacacatggctggacgttaactatggttatgataagtatgatgagaataatccagatatgaagaagaagtttgatgctacagagaaagaggcgacgaatttactcaaggaaatgaaaactgaaagtggtaggaaatacttgtggtcaggagcggaaacccttgaaactaattcttctcatatgactcgtacctatcgtaatattgagaaaatcgcagaagcgatgaggaatcctaaaaccactttaaatactgacgaaaataagaagaaagtgaaagatgcccttgagtggctgcataaaaatgcatatggaaaagaaccagataaaaaagtaaaagaattaagtgagaattttactaaaacaactggcaagaataccaacttaaattggtgggattatgaaattggaacacctaaatcattaacaaatacgcttatattgctgaatgatcaattttcaaatgaagaaaagaaaaaattcactgcccctattaaaactttcgccccagatagtgacaaaatattatcttctgtaggaaaagctgaacttgctaaaggcggaaatctagtagacatttctaaggtgaaacttttagaatgtattatcgaagaagataaagatatgatgaaaaagtctatagattcatttaataaagtcttcacttacgttcaagattctgccactggtaaagaacgtaatggattttataaagatggctcttacattgatcatcaagacgttccatacactggtgcttatggcgttgtactcttagaggggatttctcaaatgatgccgatgataaaagaaacaccttttaatgataaaacccaaaatgatacaaccttaaagtcatggattgacgacggatttatgccactcatttataaaggtgaaatgatggatttatcacgaggtagagctatcagtcgtgaaaatgaaaccagtcactcagcatctgcaacagtaatgaaatcattgttgagattaagtgatgccatggatgattcaacaaaagctaagtataaaaagattgtcaaatcttcagtagagtcagattcaagttataaacaaaatgattatttaaattcatattcggacatagataaaatgaagtctttaatgacagataacagtatttctaaaaacggattaacacaacaacttaaaatatataatgacatggatcgtgtcacctatcataacaaagacttagactttgcatttggtttaagtatgacgtcgaaaaacgtagcacgctatgaaagtatcaacggagagaatttaaaaggttggcacactggtgctggaatgtcttatttatataacagcgatgtcaaacactatcatgataacttctgggtgacagccgatatgaaacgtttatcaggtacaacaactttagacaatgaaatattaaaagatacggatgataaaaagtcgagtaaaacttttgttggcggaacaaaagttgatgaccaacatgctagtatcggaatggattttgaaaatcaggacaaaactttaactgccaaaaaatcatatttcatattaaacgataaaattgtcttcttaggaactggcattaaaagtactgattcatcaaagaatccagttacaacgattgaaaatcgcaaagcgaatgggtatacgttatatacagacgataaacaaacaaccaattctgataatcaggaaaacaattcagtctttttagagtccacagataccaaaaagaacatcggttatcattttttaaacaaaccgaaaataactgtaaaaaaagaaagtcatactggtaagtggaaagaaataaataaaagtcaaaaggatacacaaaaaactgatgagtattatgaagtaactcaaaagcattctaattctgacaataaatatggatatgtgttgtatccaggcttatctaaagatgtctttaagacaaaaaaagatgaagtaactgtcgttaagcaagaagatgacttccacgttgtgaaagataatgaatcggtttgggctggtgttaattatagtaatagcactcaaacttttgacattaacaacactaaagtcgaagttaaagccaaaggtatgtttatacttaaaaagaaagatgataacacttatgaatgtagcttctataatcctgaatctacaaattccgcttcagatattgaatctaaaatttcaatgaccggttactctattacaaacaaaaatacgtcgacttctaatgaatccggcgtgcactttgaattaactaaa

SEQ ID NO: 5394 - protein, 809 aa, Staphylococcus aureus
  MISC_FEATURE (1)..(809): hyaluronate lyase precursor
MSMTYRIKKWQKLSTITLLMAGVITLNGGEFRSVDKHQIAVADTNVQTPDYEKLRNTWLDVNYGYDKYDENNPDMKKKFDATEKEATNLLKEMKTESGRKYLWSGAETLETNSSHMTRTYRNIEKIAEAMRNPKTTLNTDENKKKVKDALEWLHKNAYGKEPDKKVKELSENFTKTTGKNTNLNWWDYEIGTPKSLTNTLILLNDQFSNEEKKKFTAPIKTFAPDSDKILSSVGKAELAKGGNLVDISKVKLLECIIEEDKDMMKKSIDSFNKVFTYVQDSATGKERNGFYKDGSYIDHQDVPYTGAYGVVLLEGISQMMPMIKETPFNDKTQNDTTLKSWIDDGFMPLIYKGEMMDLSRGRAISRENETSHSASATVMKSLLRLSDAMDDSTKAKYKKIVKSSVESDSSYKQNDYLNSYSDIDKMKSLMTDNSISKNGLTQQLKIYNDMDRVTYHNKDLDFAFGLSMTSKNVARYESINGENLKGWHTGAGMSYLYNSDVKHYHDNFWVTADMKRLSGTTTLDNEILKDTDDKKSSKTFVGGTKVDDQHASIGMDFENQDKTLTAKKSYFILNDKIVFLGTGIKSTDSSKNPVTTIENRKANGYTLYTDDKQTTNSDNQENNSVFLESTDTKKNIGYHFLNKPKITVKKESHTGKWKEINKSQKDTQKTDEYYEVTQKHSNSDNKYGYVLYPGLSKDVFKTKKDEVTVVKQEDDFHVVKDNESVWAGVNYSNSTQTFDINNTKVEVKAKGMFILKKKDDNTYECSFYNPESTNSASDIESKISMTGYSITNKNTSTSNESGVHFELTK

SEQ ID NO: 5395 - DNA, 852 bp, Staphylococcus aureus
atgaataaaacaaactttggggcttatttaaataaaagtaagagcaggaaaatatataagatttttgatcaaaatttgaagcgagagtttagttattggcagtttaggaaacttttcaaatcttatacaaggcagtctgatgtacatgaattaaaagtgtgtactcaaaatgatggtactattgagcaaatatggatagatgaagcaaatcaatttggagtgtcagtgacttggaaagataatagtattatcggatttgttatgcgtccgttaattaattatgatgcgattaagaatgaaacgactttaaaatacgcagtgccgacaacagattgctatgagattttttggggtggagataatgaattatataattatcactatttatacccacatcaaaggtatgctattgatttagttattaaagaaaatcataaaacatataagaatcaaggaaaagtaaatactgattatttttgttttggaaaagatatcattgcgccagcaaatggtacagttgaaaaagtagtgaatggggttcaagacaacagtattggaagtacgaatgaatcacagtttttaggaaattatattgtaattaagcacgcagaaaatgagtatagcttaatagctcatttacaccaatattcaatcattgtgaatgaggggcaaaatgttaaatatggtgatatcattgggaaggttgggaattctggcaattctactgaacctcatatacattttcaagtaatgaatgataagaatattgaagcatgtacatctttaaaaattcgatttataaataatcgagaacttatcaaaggggatgtggtctgcggattacaagctgaa

SEQ ID NO: 5396 - protein, 284 aa, Staphylococcus aureus
  MISC_FEATURE (1)..(284): conserved hypothetical
MNKTNFGAYLNKSKSRKIYKIFDQNLKREFSYWQFRKLFKSYTRQSDVHELKVCTQNDGTIEQIWIDEANQFGVSVTWKDNSIIGFVMRPLINYDAIKNETTLKYAVPTTDCYEIFWGGDNELYNYHYLYPHQRYAIDLVIKENHKTYKNQGKVNTDYFCFGKDIIAPANGTVEKVVNGVQDNSIGSTNESQFLGNYIVIKHAENEYSLIAHLHQYSIIVNEGQNVKYGDIIGKVGNSGNSTEPHIHFQVMNDKNIEACTSLKIRFINNRELIKGDVVCGLQAE

SEQ ID NO: 5397 - DNA, 819 bp, Staphylococcus aureus
atgagtatgtcaaagcgtctattattgtttgattttgatgaaacatattttaaacataatacaaatgaagaagatttaagtcatttaagagaaatggaaaaattgttggaaaaactaactaataataatgaagtgatcactgctgtattgacaggaagtacatttcaaagtgtcatggataaaatggatcaagttaatatgacgtttaaaccattacatatcttttctgatttgagttctaaaatgttcacttggaataatggcgaatatgttgaatcagaaacatataaaaagaaagtcttgagcgaaccatttttatttgaagatattgaagatatattacgtcatatttctgcgcaatataatgtcgaatttattccacaaagagcatttgaaggtaatgaaacacattataatttttattttcattcaacaggtaatcacaacaatgatagtcgtatcctagaagcacttgtcagatacgcaaatgaccaaaactatacagcgagatttagtcgaagcaatccattagctggtgatcctgaaaatgcgtatgatattgacttcacaccgtcaaatgctggaaaattatatgctactcaatttctgatgaggaaatataatataccagtaaaatcaatattaggttttggagatagcggcaatgacgaagcatatttaagctatcttgaacatgcatatttgatgtcgaatagtagagatgaagcattaaagcagaaatttagattaacaaaatatccatattatcaagggataacactgcatgttaaagaatttgttgaaggtaagtatgattat

SEQ ID NO: 5398 - protein, 273 aa, Staphylococcus aureus
  MISC_FEATURE (1)..(273): conserved hypothetical
MSMSKRLLLFDFDETYFKHNTNEEDLSHLREMEKLLEKLTNNNEVITAVLTGSTFQSVMDKMDQVNMTFKPLHIFSDLSSKMFTWNNGEYVESETYKKKVLSEPFLFEDIEDILRHISAQYNVEFIPQRAFEGNETHYNFYFHSTGNHNNDSRILEALVRYANDQNYTARFSRSNPLAGDPENAYDIDFTPSNAGKLYATQFLMRKYNIPVKSILGFGDSGNDEAYLSYLEHAYLMSNSRDEALKQKFRLTKYPYYQGITLHVKEFVEGKYDY

SEQ ID NO: 5399 - DNA, 423 bp, Staphylococcus aureus
atgaaactaaaatcatttgttactgccactttagcattgggattattatcaacggtcggagctgcattaccgagtcacgaagcatctgcagatagtaataacggctataaagaaatgactgtggatggttatcacactgttccttacacaatttcagtagatggtattactgcattacatcgaacttactttatcttcccagaaaataaaaatgttctttatcaagaaattgacagtaaagtaaaaaatgaattagcttctcaacgtggtgttacaacagaaaaaattaataatgcccaaacagcaacttatacgcttactttgaatgatggtaataaaaaagtagtgaatctaaagaaaaatgacgacgctaaaaattcaattgatccaagtacaatcaaacagatacaaattgtagttaaa

SEQ ID NO: 5400 - protein, 141 aa, Staphylococcus aureus
  MISC_FEATURE (1)..(141): hypothetical protein
MKLKSFVTATLALGLLSTVGAALPSHEASADSNNGYKEMTVDGYHTVPYTISVDGITALHRTYFIFPENKNVLYQEIDSKVKNELASQRGVTTEKINNAQTATYTLTLNDGNKKVVNLKKNDDAKNSIDPSTIKQIQIVVK

SEQ ID NO: 5401 - DNA, 714 bp, Staphylococcus aureus
gtgggagattttatgactaatgttttataccaacatggtacattaggcacattaatggcaggattattaaaaggaactgcatcaataaatgaattattgcaacatggtgacttaggtatcgctacactaacaggttcaaacggtgaggtaatctttttagatggaaaagcttaccatgcaaatgaacataaagaatttgtagaattaaaaggtgacgagttaacaccatatgcaactgtaactaaatttgtagcagatacaagctatgaaacgaaagataaatcttcagaagcagtttttgcagaaattaaggaaaagatgttgagtgaaaatttattttcagcagtaaaaatttcaggcttatttaaaaaaatgcatgtacgtatgatgccggctcaagaaccaccttatacacgtttaatcgattcagctagaagacaacctgaacaaactgaaacgtatgtcaaaggttcagtcgttggtttctttacaccagaattattccatggtatcggatcagcaggatttcatgtacactttgcgaatgatgatcgtaactttggtggacatgtcttagattttgaagtagaagatgttaaagtagaaatccaaaatatagaaacatttgaacagcattttccaattcaagataaagatttcactaaagcaaatattgactataaagatattgcagacgaaattagagaagctgaa

SEQ ID NO: 5402 - protein, 238 aa, Staphylococcus aureus
  MISC_FEATURE (1)..(238): hypothetical protein
VGDFMTNVLYQHGTLGTLMAGLLKGTASINELLQHGDLGIATLTGSNGEVIFLDGKAYHANEHKEFVELKGDELTPYATVTKFVADTSYETKDKSSEAVFAEIKEKMLSENLFSAVKISGLFKKMHVRMMPAQEPPYTRLIDSARRQPEQTETYVKGSVVGFFTPELFHGIGSAGFHVHFANDDRNFGGHVLDFEVEDVKVEIQNIETFEQHFPIQDKDFTKANIDYKDIADEIREAE

SEQ ID NO: 5403 - DNA, 438 bp, Staphylococcus aureus
atgaaattacatgagttaaaaccggcagaaggttcacgtaaagaacgcaatcgtgttggacgtggtgttgcgacaggtaacggtaaaacaagtggtcgcggacacaaaggtcaaaaagctcgttcaggcggtggtgtaagaccaggatttgaaggtggtcaattaccattattccgtcgtttaccaaaacgtggttttactaacataaatcgtaaagaatatgctattgttaacttagaccaacttaataaatttgaagatggtactgaagtaactccagctttattagtagaatctggtgttgttaagaatgaaaaatctggtatcaaaatactaggtaatggttcacttgataagaaattgacagtgaaagctcataaattctcagcttcagcagcagaagctattgatgctaaaggtggagcacacgaggtgatc

SEQ ID NO: 5404 - protein, 146 aa, Staphylococcus aureus
  MISC_FEATURE (1)..(146): 50S ribosomal protein L15
MKLHELKPAEGSRKERNRVGRGVATGNGKTSGRGHKGQKARSGGGVRPGFEGGQLPLFRRLPKRGFTNINRKEYAIVNLDQLNKFEDGTEVTPALLVESGVVKNEKSGIKILGNGSLDKKLTVKAHKFSASAAEAIDAKGGAHEVI

SEQ ID NO: 5405 - DNA, 1662 bp, Staphylococcus aureus
atgactgataaaaagtacactgcagccgatatggttattgatactttgaaaaataatggggtagaatatgtttttggtattccgggtgcaaagattgactatctatttaatgctttaattgatgatggtcctgaacttattgtcactcgtcatgaacaaaacgccgcaatgatggcgcaaggtattggaagattaacaggcaaaccgggtgtagtacttgttacaagtggtcctggtgtaagtaatttaactactggattattaaccgcaacatctgaaggggatcctgtattagcgttaggtggccaagtgaaacgtaatgatttattacgattaacgcatcaaagtattgataatgctgcgctattaaaatattcatcaaaatatagtgaagaagtacaagatcctgaatcattatcagaagttatgacaaatgcaattcgaattgctacttcaggaaaaaatggcgcaagttttattagtattccgcaagacgttatttcttcaccagttgaatctaaagctatatcactttgccaaaaaacaaatttaggagtaccgagtgaacaagatattaatgatgtcattgaagcgattaaaaatgcatcatttcctgttttattagctggtatgagaagttcaagtgcagaagaaacaaatgccattcgcaaattagttgagcgcacgaatttaccagttgtagaaacattccaaggtgcaggtgtaattagtcgtgaattagaaaatcatttcttcggtcgtgtgggcttattccgcaatcaagttggtgatgaattattacgtaaaagtgatttagttgttacaatcggttatgatccaattgaatacgaagctagtaactggaataaagaattagaaacacaaattatcaatattgacgaagttcaagctgaaattactaattatatgcaaccgaaaaaagagttgattggtaatattgctaaaacgattgaaatgatttctgaaaaagtggatgagccatttataaatcaacaacatttagacgaattagaacaattaagaacacatattgatgaagaaactggtattaaagcgacgcatgaagaaggaattctacatccagtggaaattattgaatctatgcaaaaggtattaactgatgatactactgtaacagttgatgttggaagtcactatatttggatggcacgtaatttcagaagttacaatccaagacatttattatttagcaatggtatgcaaacgcttggtgtagcattaccgtgggcaatttcagctgcacttgtgcgccctaatacgcaagttgtgtccgttgctggcgatggtggctttttattttcatcacaagatttagaaacggccgtacgtaaaaatttaaatatcatccagcttatttggaatgatggaaaatataacatggttgaattccaagaagaaatgaaatataaacgttcgtcaggtgtagacttcggtcctgtagattttgtaaaatatgcagaatcatttggcgcgaaaggtttacgagttactaatcaagaagaattagaagcggcaattaaagagggctatgaaacagatggtccagtattaattgatatacctgtaaattacaaagataatatcaaactttcaacaaatatgttacctgacgtatttaac

SEQ ID NO: 5406 - protein, 554 aa, Staphylococcus aureus
  MISC_FEATURE (1)..(554): alpha-acetolactate synthase
MTDKKYTAADMVIDTLKNNGVEYVFGIPGAKIDYLFNALIDDGPELIVTRHEQNAAMMAQGIGRLTGKPGVVLVTSGPGVSNLTTGLLTATSEGDPVLALGGQVKRNDLLRLTHQSIDNAALLKYSSKYSEEVQDPESLSEVMTNAIRIATSGKNGASFISIPQDVISSPVESKAISLCQKTNLGVPSEQDINDVIEAIKNASFPVLLAGMRSSSAEETNAIRKLVERTNLPVVETFQGAGVISRELENHFFGRVGLFRNQVGDELLRKSDLVVTIGYDPIEYEASNWNKELETQIINIDEVQAEITNYMQPKKELIGNIAKTIEMISEKVDEPFINQQHLDELEQLRTHIDEETGIKATHEEGILHPVEIIESMQKVLTDDTTVTVDVGSHYIWMARNFRSYNPRHLLFSNGMQTLGVALPWAISAALVRPNTQVVSVAGDGGFLFSSQDLETAVRKNLNIIQLIWNDGKYNMVEFQEEMKYKRSSGVDFGPVDFVKYAESFGAKGLRVTNQEELEAAIKEGYETDGPVLIDIPVNYKDNIKLSTNMLPDVFN

SEQ ID NO: 5407 - DNA, 237 bp, Staphylococcus aureus
ttgtgcgttgtgattatgagggatgttggattgattgatgtagaggattgttacgatatttttgggatgtggtgtttagtcaatggcgggctgaaattgtcgttttatggtgggctgaaaatgctgttttatgtcgggcttgaatttgtcgttttatggagatataaaaagccacagcaagacttagatctaactgtgacttatacatttcatacttatatttatcgattggtttta

SEQ ID NO: 5408 - protein, 79 aa, Staphylococcus aureus
  MISC_FEATURE (1)..(79): hypothetical protein
LCVVIMRDVGLIDVEDCYDIFGMWCLVNGGLKLSFYGGLKMLFYVGLEFVVLWRYKKPQQDLDLTVTYTFHTYIYRLVL

SEQ ID NO: 5409 - DNA, 180 bp, Staphylococcus aureus
ttgaaagattctatattttggaagaaagcttttattcctgtttattttattgttgcgatgctggtgtttctactttttaggttttatattaaaacagataacttttctatatatttaatgagtatcttcttaatttgtttaggaactgcttctatcatttataactataaaaccaatcga

SEQ ID NO: 5410 - protein, 60 aa, Staphylococcus aureus
LKDSIFWKKAFIPVYFIVAMLVFLLFRFYIKTDNFSIYLMSIFLICLGTASIIYNYKTNR

SEQ ID NO: 5411 - DNA, 1404 bp, Staphylococcus aureus
atgaataatagtaattttttaaatgtagagttaataggtactaaaataataacaatggaagacttttataaaatgaaggaagaagaatttttcttaaaatctaagctacctttatatttatattccttcaactatgtagatgaatatacaatgaaattacttgatagaggaagaatatctatattaaatacgaaaacaaataaagattgtatatttgacatttcaaagtatatacatgagaatattatattcagaagagatatatttgaattaaatgatataagagatgatgatttgaagtataaaattaatggttacaatattgaggtatacttaagtggtgaattggagaaaattgtaaaacatttattcgaaaacaagtttgatgtagagtatggtttttatattttatttattaaaccaatatttgaaattgttttttcttctaactatgttaaagaagaattcaatacaaaaatcgaatcatcagaatatagagagagcttagatagttttaatgaaattttaatgaaatatctagaaaatgaaataaatttcaaagaagtatggaaaaaatatattgatgaattatttaaaaaattaaatgttcaaaaattgttaattcataaaaaaatagaaagtttaatatcctcgtatgataaaaaaatatctgatgattgtagtatgtactcaaaagtatttgaacaatataaaaaaaacgttgtattggataaagtatattactctgaagtttataaatatagtgataatttgataaaagtattctctgaagacgtttggaacataatggggtataaaaaatataatgaatattttacaaacagagatgatactacattaaaaattactaatttatatattgggcaatcttttggtacagagggtaatagaaatgtcattgatagaatagggaaaggtcatgaaaaattacaagaaattatgacttatcagccagaaaatagaaagactgtcttaatattttacaagatacagcctgacaatatttatattacaaaccaatatggtaaagaggctgtgtctcgattaaaaagaattttagagcaaagtatacctaataaagaatatattgatttatcagagatatcattaattacattttttaaaccagaatataataaacaacatgtgaatgaggagtttaattctttatcttcttcgaaaataaagaatttagccaaagaaaatgatggtattattatttatttaaattttaaggatgttaattatcaactgataagtgaaggcaatacttttttttctgcaaaaccatatttgcattgtgtgttcaataaagatattttaaatatggataaagttgatatagaaaattttttcaaaagtatagaagtcaaatacagtaaa

SEQ ID NO: 5412 - protein, 468 aa, Staphylococcus aureus
MNNSNFLNVELIGTKIITMEDFYKMKEEEFFLKSKLPLYLYSFNYVDEYTMKLLDRGRISILNTKTNKDCIFDISKYIHENIIFRRDIFELNDIRDDDLKYKINGYNIEVYLSGELEKIVKHLFENKFDVEYGFYILFIKPIFEIVFSSNYVKEEFNTKIESSEYRESLDSFNEILMKYLENEINFKEVWKKYIDELFKKLNVQKLLIHKKIESLISSYDKKISDDCSMYSKVFEQYKKNVVLDKVYYSEVYKYSDNLIKVFSEDVWNIMGYKKYNEYFTNRDDTTLKITNLYIGQSFGTEGNRNVIDRIGKGHEKLQEIMTYQPENRKTVLIFYKIQPDNIYITNQYGKEAVSRLKRILEQSIPNKEYIDLSEISLITFFKPEYNKQHVNEEFNSLSSSKIKNLAKENDGIIIYLNFKDVNYQLISEGNTFFSAKPYLHCVFNKDILNMDKVDIENFFKSIEVKYSK

SEQ ID NO: 5413 - DNA, 1134 bp, Staphylococcus aureus
atggaaattcatgtttatacgggaccgctttgtggatttaatgaatatattaattctgaagttaaagaatatcaccgcttcatggaattaatcagagaatacaatatcatagtgcgagcaagtgatacatttggaactcatgatgttgacggtatttttgatactgagatagaaaatcttgtgatattttcaaacgactttgcttctgtaacaactcatgttattactaattttataaatatcgttactttaggtagaaatattaagaaaatctatattcagaatcctccaaaaagagtatttcaatcactaaatagttttcacgattctgaaataatagaaataaactatgaatatacaacattaaaaaaagatgatgtaataaatttttataaagagcagatggctggttctaaaataataggtcaaacagacgctaaaaaacaaatgagcatagatttatataaacatacttccttagaaaataataaaccgaccgtaatgctttactatggtccatcaggtgttggaaaaacagaattagccaaagaaatagcaaaaaaatataaaggtaatatcactagaatacaattttctatgatgcagaatgatgaatcttttaattatatctttggagatgaacatgccaaagtatcattgtcaaaagatttagtagatcgtgaaactaatgttgttttaattgatgaatttgataaggtattaccaatctattacaatgttttctatcaaatgtttgatgaaggtattattgaagatgccaattataaagtagacgtttcaaattgtattttcattctaacatctaattttaatagtattgaagaagcaatagttaatattggagaaccggtattttctagaatagattcctgtattaaatttttatatttaacacaggaagaaaagcagaaagtaatagaaaataaattaaatgaaatactatcatctctaaatgaaaaagaaaaaagaatagttaccgcatataacttgttagagaaatataaagagacagaaatagatatcgataacattaggtatttaaagaaaataataacaaatgatatttatacaataatttttgaagatgaattatttaatacggatattatagat

SEQ ID NO: 5414 - protein, 378 aa, Staphylococcus aureus
  MISC_FEATURE (1)..(378): endopeptidase
MEIHVYTGPLCGFNEYINSEVKEYHRFMELIREYNIIVRASDTFGTHDVDGIFDTEIENLVIFSNDFASVTTHVITNFINIVTLGRNIKKIYIQNPPKRVFQSLNSFHDSEIIEINYEYTTLKKDDVINFYKEQMAGSKIIGQTDAKKQMSIDLYKHTSLENNKPTVMLYYGPSGVGKTELAKEIAKKYKGNITRIQFSMMQNDESFNYIFGDEHAKVSLSKDLVDRETNVVLIDEFDKVLPIYYNVFYQMFDEGIIEDANYKVDVSNCIFILTSNFNSIEEAIVNIGEPVFSRIDSCIKFLYLTQEEKQKVIENKLNEILSSLNEKEKRIVTAYNLLEKYKETEIDIDNIRYLKKIITNDIYTIIFEDELFNTDIID

SEQ ID NO: 5415 - DNA, 789 bp, Staphylococcus aureus
ttgacaaatactatcaaaaaaataatttattttgatgaactatcagcaatggatttattacagatagagaagaaaggtaaccttactaaaacagttcagttgatgcatgatgaaaaaggtagtgcaagtggtgaatctaaagtgaacatggaatttggtaagcaaagcgctgtaaaacaaatttttgattctttacttgggatgtcagcgagtgcttcggctagtgcaggtataaatggaaatataactggagagcgagtagccaaaacaattttagagaatacattaatatatgattttttggatacagtagagtttagaaagaaaaaaactattattgatatttcagaggggtttaaactaaatattcaacaagatacgatgacatatttcgcgactattacccccatagcaagtatgtttgaaggatctaaacatctagacgaggaggagctatcatttgatgtttcaaaaatgaatgaagcgattagaagtattaaaggctattttgaattaataggaacaagagggaatgaaaacagagtttttagatttaatatagaatcttttaaaaataactatagaatacaagatttaaaatttatgaatttaacactctactcagtacttgttggtgaaataagcaaagaaaatctaaattacgataaagagtttgatctaaatcaaggtgccaaacctagtggaattggaaagtttaagggaattagatcagaagcaactaaagaagataaatatcaagtgtatgatgttattcttgcaggagtgaaa

SEQ ID NO: 5416 - protein, 263 aa, Staphylococcus aureus
LTNTIKKIIYFDELSAMDLLQIEKKGNLTKTVQLMHDEKGSASGESKVNMEFGKQSAVKQIFDSLLGMSASASASAGINGNITGERVAKTILENTLIYDFLDTVEFRKKKTIIDISEGFKLNIQQDTMTYFATITPIASMFEGSKHLDEEELSFDVSKMNEAIRSIKGYFELIGTRGNENRVFRFNIESFKNNYRIQDLKFMNLTLYSVLVGEISKENLNYDKEFDLNQGAKPSGIGKFKGIRSEATKEDKYQVYDVILAGVK

SEQ ID NO: 5417 - DNA, 291 bp, Staphylococcus aureus
atgaagcaccctaaaaagggcgtgttggatacagtaatatacaataccgatattacagttactaacattccaaataaagtatataattatattgtgaatggcaagcctgctattgaatggattatagatcagtacaacgtaagcatcgacaagaaatctggaatattagatgatcctaatgaatttagtgaagatccgaattacattttaaatctgcttttatcagttattactgtaagtatgaaaactcttggattaatagataaattaccagattttgaagtattagat

SEQ ID NO: 5418 - protein, 97 aa, Staphylococcus aureus
MKHPKKGVLDTVIYNTDITVTNIPNKVYNYIVNGKPAIEWIIDQYNVSIDKKSGILDDPNEFSEDPNYILNLLLSVITVSMKTLGLIDKLPDFEVLD

SEQ ID NO: 5419 - DNA, 879 bp, Staphylococcus aureus
gtgaatggtttaaccgatgagacaagtgattggattaatcagggagacataaactatgagaattatttaccaatgtatgattccaaggatattgaaaattctatatatttagatcaatttaatggagtaaattcagcaagagataattgggtaacaaatttttcgaatgaaaaagcattagtaaatgcaaaattacttgtagataactataattctgaaatagatagattaattgatatcttagattcaagagaacgtataaatttagtgaacaaagatgaaacatttattagttggacacgaggacttacccaaaaattttctaaaggaaaaaatatttcaattaatccagagagaattgttaaatttatgcatagaccatttacaaaaaaatggatagtgtacgacaaaaatattatggaaatgccaagtagatattataatataatggagaatactggacaggtgatttatatacaaggacagggaatgaataaagaattctcggctatgatcacggacatattacctaatttccaatttattggtaatggcaaaggctttgctacatacaaaggtaaagatagtttgaggcttgtagataatatttctaattcttttaaaaagaaaataaatcttaattcagaagagatagtatattatatatatgcaattttgcatcataaatattatgtgaacaaatattcaagtgatttgagtaaaggttttccgcgaataccgatattaaaggatgtatatggatttgttgaaattggtagggagttagtggaattacatttaaattatgaaaaacaactcaattgggatggtgtagaaataatttataataatatgaatccgaattataaagttgaaaaa

SEQ ID NO: 5420 - protein, 293 aa, Staphylococcus aureus
VNGLTDETSDWINQGDINYENYLPMYDSKDIENSIYLDQFNGVNSARDNWVTNFSNEKALVNAKLLVDNYNSEIDRLIDILDSRERINLVNKDETFISWTRGLTQKFSKGKNISINPERIVKFMHRPFTKKWIVYDKNIMEMPSRYYNIMENTGQVIYIQGQGMNKEFSAMITDILPNFQFIGNGKGFATYKGKDSLRLVDNISNSFKKKINLNSEEIVYYIYAILHHKYYVNKYSSDLSKGFPRIPILKDVYGFVEIGRELVELHLNYEKQLNWDGVEIIYNNMNPNYKVEK

SEQ ID NO: 5421 - DNA, 528 bp, Staphylococcus aureus
atgcgtacactgtattattttttgataggtattttactattttatatagatactgcaattgggcttcttattccaatgcacataggtaagtttgaacttgtatttgtaccacaccttacatttatgtatattttaatgatggtagtgtatcgtggctttggcgtatcattattgctcagcatatttttaggcgtaatgactgatgtatactttggtagtatttatggagtgtacttatttggctatatattgtttttagcacttatagatcgattctttaaaattttttacaaagatcattcgatgttattcattattatattagccagcaccttattattagaagtctatgtggcattaatatacggtatgttaggattcattcaatttgatattattcattttgtagtctttagattattgccaacattaattatgaattttgtactgttgattatgctttatccgttgattataaagttccttaaacaaacaaacaatgacattgacatgaaacgtcgtcaatgg

SEQ ID NO: 5422 - protein, 176 aa, Staphylococcus aureus
  MISC_FEATURE (1)..(176): hypothetical protein
MRTLYYFLIGILLFYIDTAIGLLIPMHIGKFELVFVPHLTFMYILMMVVYRGFGVSLLLSIFLGVMTDVYFGSIYGVYLFGYILFLALIDRFFKIFYKDHSMLFIIILASTLLLEVYVALIYGMLGFIQFDIIHFVVFRLLPTLIMNFVLLIMLYPLIIKFLKQTNNDIDMKRRQW

SEQ ID NO: 5423 - DNA, 849 bp, Staphylococcus aureus
gtgttctgggtgcttaagttttttaaaaataacaaattaattgttgttttatgtgcaattatcgtttttattgcattaattgggctgtccatacgttcacaatctcaatcacctcctgaacaatatataggtgattctgtgtcttttggacaacgagttgtgagttatccagttaattttgttgctggtacgattggggacttttttaaaaaaggagattctaaagaatctaaaaataagattagccagttagaatctaagaaccaacaattagaagcggaaaatgaaaaattaaaaaaagagcttgatttaaaagatatttcaaaatttgatcctatttctactacggttttggcaagaaatccggatcagtggatgaatacaattgtaattgataagggatctaaatcaggtataacttcaaatatggctgtgatgacatcacaaggttttgttggaagagttactaaagttaataaattttcttcacaagttgatttaatctcaactaatacacgtgcgggtaaattatctgtaaatatacaacacggttctaaaaatatatttggtttaattgatcgttatgatgaaaagaactcagaacttgtaattagtgacattaataatagagataatatctcaaaaggtgataaagtcgttacaagtggattagctgatcaactaccaagtaatttatatataggagaagtgactaaggttcaaaatgatcaatacggcttagctaaagaagttagggttaagactggtgcggacttaacagatttgagtcatgtttatgttgcaaaaagagatcctaaaacaattcctgatgatgaaagcagggataaa

SEQ ID NO: 5424 - protein, 283 aa, Staphylococcus aureus
  MISC_FEATURE (1)..(283): hypothetical protein
VFWVLKFFKNNKLIVVLCAIIVFIALIGLSIRSQSQSPPEQYIGDSVSFGQRVVSYPVNFVAGTIGDFFKKGDSKESKNKISQLESKNQQLEAENEKLKKELDLKDISKFDPISTTVLARNPDQWMNTIVIDKGSKSGITSNMAVMTSQGFVGRVTKVNKFSSQVDLISTNTRAGKLSVNIQHGSKNIFGLIDRYDEKNSELVISDINNRDNISKGDKVVTSGLADQLPSNLYIGEVTKVQNDQYGLAKEVRVKTGADLTDLSHVYVAKRDPKTIPDDESRDK

SEQ ID NO: 5425 - DNA, 177 bp, Staphylococcus aureus
atggctaaattacaaattaccctcactcgtagtgttattggtcgtcctgaaacacaacgtaaaactgttgaagctttaggtcttaaaaagactaacagttcagtagttgttgaagataaccctgctattcgtgggcaaatcaacaaagttaagcacttagtaacagtagaagaaaaa

SEQ ID NO: 5426 - protein, 59 aa, Staphylococcus aureus
  MISC_FEATURE (1)..(59): 50S ribosomal protein L30
MAKLQITLTRSVIGRPETQRKTVEALGLKKTNSSVVVEDNPAIRGQINKVKHLVTVEEK

SEQ ID NO: 5427 - DNA, 117 bp, Staphylococcus aureus
atggcagaacaatcaaaacagaaacaagctaatgaacaacaaaaggcccagaacttattcgcacgttggagacaacttcagaattcgaacagtgaatcctcgaacgatacaaacaaa

SEQ ID NO: 5428 - protein, 39 aa, Staphylococcus aureus
MAEQSKQKQANEQQKAQNLFARWRQLQNSNSESSNDTNK

SEQ ID NO: 5429 - DNA, 471 bp, Staphylococcus aureus
atgagattgatatttagtatgattaaaaacattatagcagtaatagcaattgtgataattgtttatatcgccttgaaatacgcaccttttttaaaagaacaagattggaatcctgtaaatcacgataatgatcaaatgaatcaagttacgcaacccactaatgatgcccaacatgtttatgtaagtggtgagaaatattcattaaaagaaaatgatttaataaagaatgtaccattaagccaaattaaaaatgtatttaaaatgatagataaacaagagtttatggctgtgtctggaatgaatcgcatggcttataatgatcaatatattataggtcaaagaggagacgaatttattctttataaatttggagatgagtcaatgcgtgtttacaatactgaatttgaaatgcaacaagacttaaatgaattagggcaaaatttacaactaaaatctgaaaatgcttatcaa

SEQ ID NO: 5430 - protein, 157 aa, Staphylococcus aureus
  MISC_FEATURE (1)..(157): hypothetical protein
MRLIFSMIKNIIAVIAIVIIVYIALKYAPFLKEQDWNPVNHDNDQMNQVTQPTNDAQHVYVSGEKYSLKENDLIKNVPLSQIKNVFKMIDKQEFMAVSGMNRMAYNDQYIIGQRGDEFILYKFGDESMRVYNTEFEMQQDLNELGQNLQLKSENAYQ

SEQ ID NO: 5431 - DNA, 324 bp, Staphylococcus aureus
ttgtgtataatacctacgaagtactttcattggaggaaaaaagcgactctatttattattatcggggttctcgtgccaatggtttataccatgcagttaaatattaaaaatgaacctgtaacaaagcgcaatcttttaataacattagctttatctacgttaggtattttagtaaccgcgttagcaggtgtaatcgttacgaaacaagcttttcctttattaagtgtagcaattggctcaatttttactggaatcgtttggggccttttactaagtggtagctacgcgctgatacgatttttatctaacgcatttgggcgtaag

SEQ ID NO: 5432 - protein, 108 aa, Staphylococcus aureus
  MISC_FEATURE (1)..(108): hypothetical protein
LCIIPTKYFHWRKKATLFIIIGVLVPMVYTMQLNIKNEPVTKRNLLITLALSTLGILVTALAGVIVTKQAFPLLSVAIGSIFTGIVWGLLLSGSYALIRFLSNAFGRK

SEQ ID NO: 5433 - DNA, 684 bp, Staphylococcus aureus
ttgaaaattaaagaaatggtaacttcagaaatgccaagagaacgtttgttaagccatggtgcaaaaagtctttcgaatacagaattattagctatattaattaacaccggaagaaaaggattctcgagcatagacattagtaatgaactgcttaaatctgcttcgaatctgaatgaattgaaaaaatcttcaattaacgatttgataaaagttaaagggattggattacaaaaagcaattactttaaaagcagcatttgagttaggggaaaggatggggagaagagctgaaaataatcgtataaaaataacgcaaccaagtgatgttgctgattatatgattccaacaatgaaagatttaacacaagaacattttgtcattttattgttaaattcaaaaaatgtagtgattaaagaaacctgtgtttttaaaggtacattaaatagttcgattgtacatccacgtgaaatttttagtattgcggtgagagaaaatgccaatgcaatcatcgcagttcataatcatccatccggtgatgtaacgccctcacaagaagatatcataacaacaatgaggttgaaggagtgtggtttgattttagggatagatttattggatcatattataatcggtgataatagatttaccagtcttgaagaagcgggttactttgatgaaaatgat

SEQ ID NO: 5434 - protein, 228 aa, Staphylococcus aureus
  MISC_FEATURE (1)..(228): DNA repair protein RadC
LKIKEMVTSEMPRERLLSHGAKSLSNTELLAILINTGRKGFSSIDISNELLKSASNLNELKKSSINDLIKVKGIGLQKAITLKAAFELGERMGRRAENNRIKITQPSDVADYMIPTMKDLTQEHFVILLLNSKNVVIKETCVFKGTLNSSIVHPREIFSIAVRENANAIIAVHNHPSGDVTPSQEDIITTMRLKECGLILGIDLLDHIIIGDNRFTSLEEAGYFDEND

SEQ ID NO: 5435 - DNA, 705 bp, Staphylococcus aureus
ttggtagtattgttatcttatagttgcagttgtatttttagttttctatatcaatttatatctatagaagaaacgtcatttgattatttacatagaagatcgaaatgtgattattgtaattcgtcactcaaatggtatgaattaatgccgattattagttttttattattaaaagggcgatgtcgaaactgtcgaaagcgtatttccctaacacatttcttaggggaaacctttgctttaatacctatcgtctttattaagtatgatttcacatacgtaaatgctacgctatttataactacatatgtttttctgcttatttttactatgaccgatatcacttctttaatgttagattgtcgcttaattataatttattgtatcgtttctctctcgttaagtatgatttatccagtagcttttatcattattagtatgaccacgcatatattctactttttatttcgggcatatattggttatggtgacgttttactaatatctgcactttctttgtttttccctctccaattcactatttatgtcattttatttacatttgtcattgctggtttagttgctttaattaccatgatatttaagccgattaaactattaccccttgttccatttatatttatttccttttttatcaattcacttttttataatgatatccatcaatttttaggaggcgtatatttt

SEQ ID NO: 5436 - protein, 235 aa, Staphylococcus aureus
  MISC_FEATURE (1)..(235): hypothetical protein
LVVLLSYSCSCIFSFLYQFISIEETSFDYLHRRSKCDYCNSSLKWYELMPIISFLLLKGRCRNCRKRISLTHFLGETFALIPIVFIKYDFTYVNATLFITTYVFLLIFTMTDITSLMLDCRLIIIYCIVSLSLSMIYPVAFIIISMTTHIFYFLFRAYIGYGDVLLISALSLFFPLQFTIYVILFTFVIAGLVALITMIFKPIKLLPLVPFIFISFFINSLFYNDIHQFLGGVYF

SEQ ID NO: 5437 - DNA, 1269 bp, Staphylococcus aureus
atgaattacctagagagcttgtattggatacacgaaagaactaaatttggcatcaaaccaggtgttaaacgtatggaatggatgctagcacaatttaataatcctcaaaataacattaagggtattcatgtaggtggcacaaatggtaaaggctctacagttgcttaccttagaacagctttagttgaaaatggttatgaagtaggtacatttacgtcgccgtttattgaaacatttaatgaacgaattagtctaaatggtgtgccaatatcaaatgacgctattgtagaattagtatcacgtattaaaccagtaagtgaaatgatggaacgtgaaacagatttaggtgttgcaactgaattcgaaataatcacagcgatgatgtttttatattttggtgaaatacatcctgttgattttgtcattgttgaggctggattgggtataaagaacgattcgacaaatgtctttacaccggttttatcaatcttaactagtatcggtctagaccatacagatattttaggtggtacttatctagatattgctagggataaaggcgcgattataaagcctaacgttccagtgatatatgctgttaaaaatgaagatgcattaaaatatgttcgtgaacgcgcaattgaacaacatgcaaagccaattgaattagatagagaaattgttgttgtatcgcaaaatgatgaatttacttaccgttataaagattatgaattagaaacaatcattttaagcatgttaggtgaacatcagaaacaaaatgctgcattagccataacagctcttattgaattaaatgaacaaggattaattgaattagatttcaataagatgatagacggtattgaatcagttcgttggactggacgtattgagcaggtgcatgacaaacctttaatcattttggatggcgcacataattcagagagtatagatgctctaattgatacaattaaacagtaccatgataaagaaaaagtagatattttgttctcagcaataaacggaaaaccgattaacgagatggtcaaacatttaagtttaattgcgcatacgttttatgcaactgaatttgattttccgaaagcgttacgcaaagaagaaattgtaggtagtattgaaaatgatgaaatacaattagtagatgactacgttgaatttataaaaaattatcaaggtgatacattagtaattaccggtagtctgtatttcataagtgaagttaaatcaaaattagactttgaagcatta

SEQ ID NO: 5438 - protein, 423 aa, Staphylococcus aureus
  MISC_FEATURE (1)..(423): folylpolyglutamate synthase
MNYLESLYWIHERTKFGIKPGVKRMEWMLAQFNNPQNNIKGIHVGGTNGKGSTVAYLRTALVENGYEVGTFTSPFIETFNERISLNGVPISNDAIVELVSRIKPVSEMMERETDLGVATEFEIITAMMFLYFGEIHPVDFVIVEAGLGIKNDSTNVFTPVLSILTSIGLDHTDILGGTYLDIARDKGAIIKPNVPVIYAVKNEDALKYVRERAIEQHAKPIELDREIVVVSQNDEFTYRYKDYELETIILSMLGEHQKQNAALAITALIELNEQGLIELDFNKMIDGIESVRWTGRIEQVHDKPLIILDGAHNSESIDALIDTIKQYHDKEKVDILFSAINGKPINEMVKHLSLIAHTFYATEFDFPKALRKEEIVGSIENDEIQLVDDYVEFIKNYQGDTLVITGSLYFISEVKSKLDFEAL

SEQ ID NO: 5439 - DNA, 2628 bp, Staphylococcus aureus
atggaaatgaaaccaaaatatgatcctcgtgaagttgaagcgggacgttatgaagaatgggtaaagaatggttattttaaaccgtcagaagataaatcaaaagaaacatatacaattgttatcccgccaccaaatgtaactggtaaattacatttaggacatgcatgggatacgactttacaagatatcattacacgtatgaaacgtatgcaaggatacgatacgttatacttaccaggtatggatcatgctggtattgcgacacaggcaaaggtagaagctaaattaaatgaacaaggaataactagatatgatcttggtcgtgaaaagtttttagaacaggcatgggattggaaagaagagtatgcgtcatttattcgtgcgcaatgggctaaattaggtctaggtttagattatagtagagaacgttttactttagatgaaggtttaagtaaagcagttaaaaaagtttttgttgatttatacaataaaggaattatttatcgtggcgaacgtattataaattgggatcctaaagcacgtacagctttatctgatattgaagtaatacatgaagatgttcaaggtgcgttttatcattttaaatatccttacgctgatggtgaaggttttattgaaattgcaacaacaagaccagaaacgatgttaggtgatacagcgattgttgttaaccctaatgacgaacgatacaaagatgtaatcggtaaaactgttatattaccaatcgtaggacgcgaactgcctattttagcagatgagtatgttgatatagacttcggttctggtgctatgaaagtgacaccagcacatgaccctaatgattttgaaattggtcaaagacatcaattagaaaatattatcgttatggatgaaaatggtaaaatgaacgacaaagcgggtaaatatgaaggtatggaccgttttgattgtcgtaaacagctagttaaagatttaaaagaacaagatttagttatcaagattgaagatcatgttcattctgtaggtcattcagaacgatctggcgctgttgttgaaccatatttatcaacacaatggtttgtgcgcatggaagacttagcgaaacgttcattagataaccaaaaaacagatgatcgtattgatttttatccgcaacgtttcgaacatacatttaaccaatggatggaaaatattagagattggacgatttcaagacaattatggtggggtcatcaaattccggcttggtatcataaagaaacaggcgaaatatatgttggagaagaagcgccaactgatattgaaaattggcaacaagatgaagatgtattagatacgtggttctcaagtgctttatggcctttctctacgttaggttggcctgatttagaaagtgaagactttaaacgatactacccaacaaatgccttagttacaggttacgatattatctttttctgggtagcacgcatgatattccaaggcttagaatttacagatcgtcgtccatttaatgatgtattattacacggtttagttcgtgctgaagacgggcgtaagatgagtaaatcattaggtaatggtgtggatccaatggatgttattgacgaatacggtgctgatagcttgcgttacttcttagcaacaggttcatctccaggacatgatttaagatactcaactgaaaaagttgagtcagtgtggaactttatcaataaaatctggaatggggcacgtttcagtttaatgaatatcggtgaagactttaaagttgaagatatcgatttaagtggtaacttatcattagcagataaatggattctaacacgtttaaatgaaacgattgcaacagttactgatttaagtgacaaatatgaattcggcgaagttggacgtgcattatataatttcatttgggatgatttctgtgattggtacattgaaatgagtaaaattccaatgaatagtaatgatgaagaacaaaaacaagttacacgttcagtattgagttatactttagacaatattatgagaatgctacatccattcatgccatttgtaacagagaaaatatggcaaagtttaccacatgaaggtgacacaattgttaaagcttcatggccagaagtgcgtgaatcattgatttttgaagaaagtaaacaaacaatgcaacaacttgttgaaatcattaaatctgtaagacaatcacgtgtagaagtaaatacgccattgtctaaagaaatacctattttaattcaagctaaagataaagaaattgaaacaactttatcacaaaacaaagattatttaatcaaattctgtaatcctagtaccttaaatattagcactgacgtggaaattcctgagaaagcaatgacatcagttgtaattgcaggtaaagtggtattaccattagaagggctaattgatatggataaggaaatcagccgtttggaaaaagaattagctaaacttcaaagcgaattagatagagtagataaaaagctctctaatgaaaactttgtaagtaaagcacctgaaaaggttataaatgaagaaaaacgtaaaaaacaagattatcaagaaaaatatgatggtgtgaaggcaagaattgaacaattaaaagca

SEQ ID NO: 5440 - protein, 876 aa, Staphylococcus aureus
  MISC_FEATURE (1)..(876): valine-tRNA ligase
MEMKPKYDPREVEAGRYEEWVKNGYFKPSEDKSKETYTIVIPPPNVTGKLHLGHAWDTTLQDIITRMKRMQGYDTLYLPGMDHAGIATQAKVEAKLNEQGITRYDLGREKFLEQAWDWKEEYASFIRAQWAKLGLGLDYSRERFTLDEGLSKAVKKVFVDLYNKGIIYRGERIINWDPKARTALSDIEVIHEDVQGAFYHFKYPYADGEGFIEIATTRPETMLGDTAIVVNPNDERYKDVIGKTVILPIVGRELPILADEYVDIDFGSGAMKVTPAHDPNDFEIGQRHQLENIIVMDENGKMNDKAGKYEGMDRFDCRKQLVKDLKEQDLVIKIEDHVHSVGHSERSGAVVEPYLSTQWFVRMEDLAKRSLDNQKTDDRIDFYPQRFEHTFNQWMENIRDWTISRQLWWGHQIPAWYHKETGEIYVGEEAPTDIENWQQDEDVLDTWFSSALWPFSTLGWPDLESEDFKRYYPTNALVTGYDIIFFWVARMIFQGLEFTDRRPFNDVLLHGLVRAEDGRKMSKSLGNGVDPMDVIDEYGADSLRYFLATGSSPGHDLRYSTEKVESVWNFINKIWNGARFSLMNIGEDFKVEDIDLSGNLSLADKWILTRLNETIATVTDLSDKYEFGEVGRALYNFIWDDFCDWYIEMSKIPMNSNDEEQKQVTRSVLSYTLDNIMRMLHPFMPFVTEKIWQSLPHEGDTIVKASWPEVRESLIFEESKQTMQQLVEIIKSVRQSRVEVNTPLSKEIPILIQAKDKEIETTLSQNKDYLIKFCNPSTLNISTDVEIPEKAMTSVVIAGKVVLPLEGLIDMDKEISRLEKELAKLQSELDRVDKKLSNENFVSKAPEKVINEEKRKKQDYQEKYDGVKARIEQLKA

SEQ ID NO: 5441 - DNA, 597 bp, Staphylococcus aureus
atgattgacaaaataagtcaatgtataggtgggaataaaatgaatgaatgcgcatttggtactaaagatccagtctacttagactatcatgatcatgtatggggacaaccgctctatgatagcaaggcattgtttaaacttttagcattagaatcacaacatgctgggctatcttggttaactattttaaaaaagaaagaagcctatgaagaagcattttatgatttcgaaccagaaaaggtagcacaaatgaccgctcaagatatcgaccgcttaatgacttttccaaatatcgttcatcatcgtaaaaaattagaagcaattgttaatcaagctcaagggtatttaaaaattgaacaagcatatggtagttttagtaaatttttatggtcatatgtaaatggtaagcctaaagatttgcagtatgaacatgcttctgatcgtatcacagttgatgatactgcaacacaactatctaaagatttaaaacaatacgggtttaaatttttaggtccagtaacagtattttcgtttttagaagcagccggtttatatgatgcacatttacaagattgtccatcaaagcctaaacataat

SEQ ID NO: 5442 - protein, 199 aa, Staphylococcus aureus
  MISC_FEATURE (1)..(199): DNA-3-methyladenine
MIDKISQCIGGNKMNECAFGTKDPVYLDYHDHVWGQPLYDSKALFKLLALESQHAGLSWLTILKKKEAYEEAFYDFEPEKVAQMTAQDIDRLMTFPNIVHHRKKLEAIVNQAQGYLKIEQAYGSFSKFLWSYVNGKPKDLQYEHASDRITVDDTATQLSKDLKQYGFKFLGPVTVFSFLEAAGLYDAHLQDCPSKPKHN

SEQ ID NO: 5443 - DNA, 1071 bp, Staphylococcus aureus
atggcaatgatatatagaaataatttcattgtgttcgttttatcattttttattagtattctactgtattcatcgcacgtattacttccatttatgtttggtcctattatcgcatcaatcatttgtgtaaaagttttcaaacttgatattaaatggccattcttacttagtgaattaggtattgtactattaggtgtgcaaatcggatcaacgtttacgaaaaatgtcgttatggatattaaaaacaattggctttcgattattgttgtatctatttcgatattattaattgcaatagtaatggcatttgtttttaaaaaaattgcacgtattaatacagaaacagctattttaagtgttataccaggagcactaacacaaatgctggtcatggctgaacaagacaaacgtgctaatttgttagttgttagcttaacgcaaacatcacgaattatatttgttgttgttttagtaccgttcatttcatatttttttcatgatggtaacatgcatgcgaatggaaagttaacaaaagtcttgcctttatcacaagtattaaacatagggcaaatagttattttagcgatagctatctttatagtttatctaattatgtctaaaataaagtttccaacatttcaattattagcaccactcattgtattaattgtttggaatttttctacaggtttaacatttacactagatcattggttgttgaacatggcacaactaatatatatgattagaattggagttcaaattgcgcatttattgtcagatttaaaaggtagactagcaatcgcaattacaattcaaaatattatgttgataattggtgcgctaatcatggtttatatcatacatttctttgataataatcctattaatgaattgtttcttggtgcagcaccaggaggggttaatcagatagttttagttgcattagctactggtgccgatgttgctatgattacgagttatcatattttccgaatctttttcatcctatttattattgcaccaggaattaattactttttaaaatatcgttcgaataagcgtgaagat

SEQ ID NO: 5444 - protein, 357 aa, Staphylococcus aureus
  MISC_FEATURE (1)..(357): conserved hypothetical
MAMIYRNNFIVFVLSFFISILLYSSHVLLPFMFGPIIASIICVKVFKLDIKWPFLLSELGIVLLGVQIGSTFTKNVVMDIKNNWLSIIVVSISILLIAIVMAFVFKKIARINTETAILSVIPGALTQMLVMAEQDKRANLLVVSLTQTSRIIFVVVLVPFISYFFHDGNMHANGKLTKVLPLSQVLNIGQIVILAIAIFIVYLIMSKIKFPTFQLLAPLIVLIVWNFSTGLTFTLDHWLLNMAQLIYMIRIGVQIAHLLSDLKGRLAIAITIQNIMLIIGALIMVYIIHFFDNNPINELFLGAAPGGVNQIVLVALATGADVAMITSYHIFRIFFILFIIAPGINYFLKYRSNKRED

SEQ ID NO: 5445 - DNA, 99 bp, Staphylococcus aureus
atgggcggcgacttgatagtgaaagtccatatatgctttgtagtcaaaactgctagcggatattgttatcttaacaaacgtgaagctcaagcagcaatt

SEQ ID NO: 5446 - protein, 33 aa, Staphylococcus aureus
  MISC_FEATURE (1)..(33): hypothetical protein
MGGDLIVKVHICFVVKTASGYCYLNKREAQAAI

SEQ ID NO: 5447 - DNA, 498 bp, Staphylococcus aureus
atggctcgtagagaagaagagacgaaagaatttgaagaacgcgttgttacaatcaaccgtgtagcaaaagttgtaaaaggtggtcgtcgtttccgtttcactgcattagttgtagttggagacaaaaatggtcgtgtaggtttcggtactggtaaagctcaagaggtaccagaagcaatcaaaaaagctgttgaagcagctaaaaaagatttagtagttgttccacgtgttgaaggtacaactccacacacaattactggccgttacggttcaggaagcgtatttatgaaaccggctgcacctggtacaggagttatcgctggtggtcctgttcgtgccgtacttgaattagcaggtatcactgatatcttaagtaaatcattaggatcaaacacaccaatcaacatggttcgtgctacaatcgatggtttacaaaaccttaaaaatgctgaagatgttgcgaaattacgtggcaaaacagtagaagaattatacaat

SEQ ID NO: 5448 - protein, 166 aa, Staphylococcus aureus
  MISC_FEATURE (1)..(166): 30S ribosomal protein S5
MARREEETKEFEERVVTINRVAKVVKGGRRFRFTALVVVGDKNGRVGFGTGKAQEVPEAIKKAVEAAKKDLVVVPRVEGTTPHTITGRYGSGSVFMKPAAPGTGVIAGGPVRAVLELAGITDILSKSLGSNTPINMVRATIDGLQNLKNAEDVAKLRGKTVEELYN

SEQ ID NO: 5449 - DNA, 1284 bp, Staphylococcus aureus
atgagatatacgaaatcagaagaagcaatgaaggttgctgaaactttaatgcctggtggtgtaaatagtccagtacgcgcatttaaatcagtagatacaccagcaatttttatggatcacggtaaaggttcaaaaatttatgatatcgatggtaacgagtatatcgactatgtactaagttggggaccacttattttaggacatagagaccctcaagttattagtcatttacatgaagcaattgataaaggtacaagttttggtgcatcaacattacttgaaaataaattggcgcagctcgttattgaccgagtaccttcaatagaaaaagtgcgtatggtgtcatctggtacagaagctacattggatactttaagattagcacgtggttatactggcagaaataaaattgtgaaatttgaaggttgctatcatggtcatagtgattcgttattaatcaaagctggttctggggtggcaacattaggattgccggattctcctggtgtgcctgaaggtattgctaaaaatacaattacagttccatacaatgatttagatgcacttaaaatcgctttcgaaaaatttggaaacgatattgctggtgtaatcgtagaacctgttgctggtaatatgggtgtcgtaccgccgattgaaggttttttacagggattaagagatattacgactgaatacggcgcattgctaattttcgatgaagtaatgactggtttcagagtcggttatcattgtgcacaaggttactttggtgtgacaccagatttaacttgcttaggaaaagttatcggtggaggactacctgtaggtgcatttggtggtaaaaaagaaatcatggatcatatagcaccattaggaaatatttatcaagcgggtacgttatcaggaaatcctcttgcaatgacaagtggttatgaaacgttaagccaattaacgccagagacatatgagtattttaatatgttaggcgatatacttgaagacggtttaaaacgtgtatttgctaaacacaatgtaccaataactgtaaatagagcaggttcaatgattggttatttcttaaatgaaggacctgtaactaattttgaacaagcgaataaaagtgatttgaaattatttgcagaaatgtatcgagaaatggcaaaagaaggtgtgtttttaccaccatctcaatttgaaggtacattcttatctacggcacacacgaaagaagatattgaaaaaacgattcaagcatttgatacggctttaagtcgtattgtaaaa

SEQ ID NO: 5450 - protein, 428 aa, Staphylococcus aureus
  MISC_FEATURE (1)..(428): glutamate-1-semialdehyde
MRYTKSEEAMKVAETLMPGGVNSPVRAFKSVDTPAIFMDHGKGSKIYDIDGNEYIDYVLSWGPLILGHRDPQVISHLHEAIDKGTSFGASTLLENKLAQLVIDRVPSIEKVRMVSSGTEATLDTLRLARGYTGRNKIVKFEGCYHGHSDSLLIKAGSGVATLGLPDSPGVPEGIAKNTITVPYNDLDALKIAFEKFGNDIAGVIVEPVAGNMGVVPPIEGFLQGLRDITTEYGALLIFDEVMTGFRVGYHCAQGYFGVTPDLTCLGKVIGGGLPVGAFGGKKEIMDHIAPLGNIYQAGTLSGNPLAMTSGYETLSQLTPETYEYFNMLGDILEDGLKRVFAKHNVPITVNRAGSMIGYFLNEGPVTNFEQANKSDLKLFAEMYREMAKEGVFLPPSQFEGTFLSTAHTKEDIEKTIQAFDTALSRIVK

SEQ ID NO: 5451 - DNA, 972 bp, Staphylococcus aureus
atgaaatttgatagacatagaagattgagatcatcagcgacaatgagagatatggttagagagaatcatgtaagaaaagaagatttaatatatccaatttttgtagttgaaaaagacgatgtgaaaaaagaaattaagtcattgccaggtgtataccaaatcagtttgaatttacttgaaagtgaattaaaagaagcttatgacttaggcatacgtgccattatgtttttcggtgttccaaactcaaaagatgatataggtactggtgcatacattcacgatggtgttattcaacaggcaacacgtattgctaaaaaaatgtatgatgacttattaattgttgcagacacttgtttatgtgaatatactgatcatggtcattgtggcgtgattgatgaccatacacatgacgttgacaatgataaatcattgccactacttgttaaaacagcaatttctcaagtggaagctggtgctgatattattgcgccaagtaatatgatggatggttttgttgctgaaattcgtcgtggattagatgaagccggctattacaatattcctataatgagttatggtgtcaagtatgcatcaagtttctttggaccttttagagatgcagcagattcagcgccatcatttggggatagaaaaacgtatcagatggaccctgctaaccgtttggaagcacttcgtgaattagaaagtgatcttaaagaagggtgcgacatgatgattgttaaacctgctctaagttatttagatatagttcgagatgttaaaaatcatacgaatgttccagttgttgcatataatgtgagtggagaatatagtatgactaaagcagcggcacaaaatggttggatagatgaagaacgtgtcgttatggaacaaatggtttcaatgaaacgtgcaggtgctgatatgattattacgtattttgcaaaggacatttgtcgctatttagataaa

SEQ ID NO: 5452 - protein, 324 aa, Staphylococcus aureus
  MISC_FEATURE (1)..(324): delta-aminolevulinic acid
MKFDRHRRLRSSATMRDMVRENHVRKEDLIYPIFVVEKDDVKKEIKSLPGVYQISLNLLESELKEAYDLGIRAIMFFGVPNSKDDIGTGAYIHDGVIQQATRIAKKMYDDLLIVADTCLCEYTDHGHCGVIDDHTHDVDNDKSLPLLVKTAISQVEAGADIIAPSNMMDGFVAEIRRGLDEAGYYNIPIMSYGVKYASSFFGPFRDAADSAPSFGDRKTYQMDPANRLEALRELESDLKEGCDMMIVKPALSYLDIVRDVKNHTNVPVVAYNVSGEYSMTKAAAQNGWIDEERVVMEQMVSMKRAGADMIITYFAKDICRYLDK

SEQ ID NO: 5453 - DNA, 666 bp, Staphylococcus aureus
atgaagccagttgtagttatgacacaaacaaatgacatgcaaagtgatttagtatcaattattcacaaaccctttattgatataaagccactaaattttgatattcatttgttaaatcaacgctatgactggcttattttttcatctaaaaatgctgtgaaattcttttataaatatctaaaaggaattaatgttgataacattgctgtgataggaagtaagacagcgcaatattgtgaatcacttggcattcgagttgattttatgccaaacgacttttctcaagaaggatttttaaaatcatttaatcaaactaaccaaaaaatacttttgccttcgagtgaattggcgagaccattgttattagcagcgttatctaaagataatgaagttgttaaaatagatttatatacttcagtgcctaacaaacaaaatatacaagatgttaaagaaatgatagaacatcaacaaatcgatgcattaacattttcaagttcgtcggcagtacgttattattttaatgaaggatttgtaccaaaattcaagtcgtattttgctattggagaacaaacagcacggaccattaaatcatatcaacaaccagtaacaattgcagaaattcaaacactcgaatcactaattgaaaagattttagaaagtaggggc

SEQ ID NO: 5454 - protein, 222 aa, Staphylococcus aureus
  MISC_FEATURE (1)..(222): uroporphyrinogen III
MKPVVVMTQTNDMQSDLVSIIHKPFIDIKPLNFDIHLLNQRYDWLIFSSKNAVKFFYKYLKGINVDNIAVIGSKTAQYCESLGIRVDFMPNDFSQEGFLKSFNQTNQKILLPSSELARPLLLAALSKDNEVVKIDLYTSVPNKQNIQDVKEMIEHQQIDALTFSSSSAVRYYFNEGFVPKFKSYFAIGEQTARTIKSYQQPVTIAEIQTLESLIEKILESRG

SEQ ID NO: 5455 - DNA, 930 bp, Staphylococcus aureus
ttgaacatgcgtaaattagtcgttggctccagaagaagtaaattagctttaacacaaagccagcaatttattgataaattaaaagctgtcgagccaaatctagaaattgaaattaaagaaattgtcacgaaaggcgatcgtatagtagataaacaattgtctaaagtcggaggcaaaggcttatttgttaaagaaatacaacatgaactttttgaaaaaaatatcgatatggcaatacactcgcttaaagacgtaccaagtgtaattccggaaggtttaacattaggttgtatccctgatagagaattaccttttgatgcgtatatttctaaaacacatacaccactatcccaattgccagaaggcagtattattggtactagttcattacgtcgtggtgcacaaatattatctaagtatcctaatttagagattaaatggattagaggtaatatagatacacgattagaaaagttacaaactgaagattatgatgcgattattttagctgcagctggtttaagaagaatgggctggtcagatgatattgtaacatcttatcttgatagagatacattgttacctgcaatcggacaaggtgctttagggatagaatgtcgtagtgacgatgaagaactattaacattattaagcaaagtacataatgatgaggttgcaaaatgtgtgactgctgaacgaacgtttttagcagaaatggatggtagttgtcaggtgccaattgcaggatatgctacaatctcagatcaaaacgaaatcgaatttacaggtttaattatgaccccagatggtaaagaacgatttgaatatacaatgaacggaacagatccggttgagttaggcaaaacagtgagtaacaaattaaaagagcaaggtgcttatgaaattataaaacgcttaaatgaacaacat

SEQ ID NO: 5456 - protein, 310 aa, Staphylococcus aureus
  MISC_FEATURE (1)..(310): porphobilinogen deaminase
LNMRKLVVGSRRSKLALTQSQQFIDKLKAVEPNLEIEIKEIVTKGDRIVDKQLSKVGGKGLFVKEIQHELFEKNIDMAIHSLKDVPSVIPEGLTLGCIPDRELPFDAYISKTHTPLSQLPEGSIIGTSSLRRGAQILSKYPNLEIKWIRGNIDTRLEKLQTEDYDAIILAAAGLRRMGWSDDIVTSYLDRDTLLPAIGQGALGIECRSDDEELLTLLSKVHNDEVAKCVTAERTFLAEMDGSCQVPIAGYATISDQNEIEFTGLIMTPDGKERFEYTMNGTDPVELGKTVSNKLKEQGAYEIIKRLNEQH

SEQ ID NO: 5457 - DNA, 813 bp, Staphylococcus aureus
atgcaagaaaacctgtttattcgattcaatgaaattatattattaatatacttaatcagtatcatttgctatttttatgattttgtacaaaaaagtcataagattagaagtttaggcatatatttattggggattgtttgggttttacaaacaatctctttatctatttttattatacaaactagacatattccattagggtctatttcagatgtattctatactttaagttggctgattatttcaatctctttaattcttaaccttatcaaagttttgaatttctctgtgtttttcttgaatttaatagggttaacacttttagggatgaatacatttcaaccgacacattatactaataaggttcagaaaattgctgttgtagacgagttactgttagtccatatcggtctagctgtgttaagttatgtcttctttgccttagcttttgtcaatgcattactgtatatcatgcaataccgtaatttgaaggaaaaacgttttgatcaaaaatactttagaattggtagcgttgctacacttgaatcaattgtgttttactcaacgttaagtgggtggataattctcatatttagtattattttaggtacacagtggggtgtaatttcagttggtgaacgtatattcattgacccgaaggtaatactctcttcaattattacagtattatatggaagttatattttacttagaatcaacaaatggttgaattcaagatatttaatatactataacattattttattttgcttaaatatgattaatttattttttgcaacacattttgtgaat

SEQ ID NO: 5458 - protein, 271 aa, Staphylococcus aureus
  MISC_FEATURE (1)..(271): hemA concentration negative
MQENLFIRFNEIILLIYLISIICYFYDFVQKSHKIRSLGIYLLGIVWVLQTISLSIFIIQTRHIPLGSISDVFYTLSWLIISISLILNLIKVLNFSVFFLNLIGLTLLGMNTFQPTHYTNKVQKIAVVDELLLVHIGLAVLSYVFFALAFVNALLYIMQYRNLKEKRFDQKYFRIGSVATLESIVFYSTLSGWIILIFSIILGTQWGVISVGERIFIDPKVILSSIITVLYGSYILLRINKWLNSRYLIYYNIILFCLNMINLFFATHFVN

SEQ ID NO: 5459 - DNA, 1371 bp, Staphylococcus aureus
ttgttagtatatatgggggcgtttcaaatgcattttattgcaattagtataaatcatcgcacagctgatgttgcactaagagagcaagttacttttagagatgatgccttacgaattgcccatgaagatttatatgaaactaaatctattttagaaaatgtcatattatcaacatgtaatcgaactgaagtatatgctgttgttgatcaaattcacacaggtcgttactatattcaacgatttctagctcgtgcatttggatttgaagtagatgatattaaagcaatgtcagaagtaaaagtgggggacgaagcagtagaacatttattgcgtgtcacttctggtttagattcaatcgtacttggagaaactcaaattttaggtcaaataagagatgcatttttcttagcgcaaagcacaggtacgacaggaacaatttttaatcatctatttaaacaggcaattacttttgcaaaaagagcacataatgaaacagatatagctgataatgctgtaagtgtgtcttatgctgcggtcgagttggcgaaaaaagtatttggcaaattgaaaagtaagcaagctatcattattggtgcaggggaaatgagtgaattatcactattaaatcttcttggttctggaattactgatattacagtagtaaatagaacaattgaaaatgctatgaaattagcagcaaagcatcaagtgaaatatgatgaactatcatcattaccaaatttacttgaaagtgcagatattgtgattagttcaacgagtgcacaatcttatatcattacaaatgaaatgatagaaagaattgcagaaaatagaaagcaagattcactagtattgattgatattgcagttcctcgagatattgaacctggtattagtgccatcacaaacatctttaattatgatgttgatgacttaaaaggtttagttgatgcaaacttacgtgagcgacaattagcggctgcaacaatttcggaacaaattcctacagaaatacatgcacacaatgagtggattagtatgttgggtgttgttccagtgattagagctttacgtgaaaaagctatggcaattcaagcagaaacgatggacagtattgatcgtaaattgccagggttaagcgaaagagaacgtaaaattatatctaaacatacaaaaagtatcatcaatcaaatgttgaaagatcctattaaacaggccaaagaattaagtagtgataagaaaagtaatgaaaaattagagctatttcaaaatatatttgatatcgaagctgaatgtcctcatgagcaagcgaagcaacaaaaagaaagcaaggtcaaggaaatttcagcgcgacgtatctttagttttgaa

SEQ ID NO: 5460 - protein, 457 aa, Staphylococcus aureus
  MISC_FEATURE (1)..(457): glutamyl-tRNA reductase
LLVYMGAFQMHFIAISINHRTADVALREQVTFRDDALRIAHEDLYETKSILENVILSTCNRTEVYAVVDQIHTGRYYIQRFLARAFGFEVDDIKAMSEVKVGDEAVEHLLRVTSGLDSIVLGETQILGQIRDAFFLAQSTGTTGTIFNHLFKQAITFAKRAHNETDIADNAVSVSYAAVELAKKVFGKLKSKQAIIIGAGEMSELSLLNLLGSGITDITVVNRTIENAMKLAAKHQVKYDELSSLPNLLESADIVISSTSAQSYIITNEMIERIAENRKQDSLVLIDIAVPRDIEPGISAITNIFNYDVDDLKGLVDANLRERQLAAATISEQIPTEIHAHNEWISMLGVVPVIRALREKAMAIQAETMDSIDRKLPGLSERERKIISKHTKSIINQMLKDPIKQAKELSSDKKSNEKLELFQNIFDIEAECPHEQAKQQKESKVKEISARRIFSFE

SEQ ID NO: 5461 - DNA, 588 bp, Staphylococcus aureus
atgaaagttaatcctaataatatagaattaatcattagtgcagtaaaagaagaacaatatccagaaacagaattgtctgaagttgcactgagcggtcgatctaatgtaggtaagtctacatttatcaatagtatgattggcagaaaaaatatggcacgtacatcacagcaacccggcaaaacgcaaacgttaaatttttataatatagatgaacaacttatttttgtggatgttccagggtatggatatgctaaagtaagtaaaacacaacgtgaaaaatttgggaaaatgattgaggaatatataactaagagagagaatttgcaattagttattcaattagttgatttaagacatgatccaacacaagatgatatcttaatgtacaattatttgaaacattttgatattcctactttagttatatgcactaaagaagacaaaattccaaaaggtaaggttcaaaagcatattaaaaatattaagacacaattagatatggacccagacgatacaattgtaagttattcatcaattcaaaataataaacaacaacaaatatggaatttaattgaaccgtatatttca

SEQ ID NO: 5462 - protein, 196 aa, Staphylococcus aureus
  MISC_FEATURE (1)..(196): conserved hypothetical
MKVNPNNIELIISAVKEEQYPETELSEVALSGRSNVGKSTFINSMIGRKNMARTSQQPGKTQTLNFYNIDEQLIFVDVPGYGYAKVSKTQREKFGKMIEEYITKRENLQLVIQLVDLRHDPTQDDILMYNYLKHFDIPTLVICTKEDKIPKGKVQKHIKNIKTQLDMDPDDTIVSYSSIQNNKQQQIWNLIEPYIS

SEQ ID NO: 5463 - DNA, 1260 bp, Staphylococcus aureus
atgtttaaattcaatgaagatgaagaaaatttgaaatgctctttctgcggaaaagaccaagatcaagtaaaaaaacttgtagcaggaagtggtgtatatatttgtaatgagtgtattgaattatgctcagaaatcgtcgaagaagaattagctcaaaacacttctgaagcgatgacagaattacctactcctaaagaaattatggatcatttaaacgaatatgttattggtcaagaaaaagctaaaaaatctttagctgtagctgtttataaccactataagcgtattcaacaattaggaccaaaagaagatgatgttgaattacaaaaaagtaacattgcattaattgggccaacaggtagtggtaaaacattattagctcaaaccttagccaagacgttgaatgtaccatttgcaattgcagatgcgacaagtttaactgaagctggttatgtaggcgatgatgttgaaaatatcttgttgagattaattcaagcagctgactttgacattgataaagccgaaaaaggtattatttatgtagatgaaattgataaaattgcacgtaaatctgaaaacacatctataacacgtgacgtttcaggtgaaggtgttcaacaagcattgcttaaaatcttagaaggtacgactgcaagtgttccgccacaaggtggacgcaaacatccaaaccaagaaatgattcaaattgatacaacaaatatcttatttattcttggtggtgcctttgatggtattgaagaagtgattaagcgccgtcttggtgaaaaagttattggtttctcaagcaatgaagctgataaatatgacgaacaagcattattagcacaaattcgcccagaagatttgcaagcctatggtttgattcctgaatttatcggacgtgtgccaattgtagctaatttagaaacattagatgtaactgcgttgaaaaacatcttaacgcaacctaaaaatgcacttgtgaaacaatatactaaaatgctggaattagatgatgtggatttagagttcactgaagaagctttatcagcaattagtgaaaaagcaattgaaagaaaaacaggtgcgcgtggtttacgttcaatcatagaagaatcgttaatcgatattatgtttgatgtgccttctaacgaaaatgtaacgaaggtagttattacagcacaaacaattaatgaagaaactgaaccagaactatacgacgcagaaggcaatttaattaataatagtaaaacatcagct

SEQ ID NO: 5464 - protein, 420 aa, Staphylococcus aureus
  MISC_FEATURE (1)..(420): protease [Staphylococcus
MFKFNEDEENLKCSFCGKDQDQVKKLVAGSGVYICNECIELCSEIVEEELAQNTSEAMTELPTPKEIMDHLNEYVIGQEKAKKSLAVAVYNHYKRIQQLGPKEDDVELQKSNIALIGPTGSGKTLLAQTLAKTLNVPFAIADATSLTEAGYVGDDVENILLRLIQAADFDIDKAEKGIIYVDEIDKIARKSENTSITRDVSGEGVQQALLKILEGTTASVPPQGGRKHPNQEMIQIDTTNILFILGGAFDGIEEVIKRRLGEKVIGFSSNEADKYDEQALLAQIRPEDLQAYGLIPEFIGRVPIVANLETLDVTALKNILTQPKNALVKQYTKMLELDDVDLEFTEEALSAISEKAIERKTGARGLRSIIEESLIDIMFDVPSNENVTKVVITAQTINEETEPELYDAEGNLINNSKTSA

SEQ ID NO: 5465 - DNA, 1299 bp, Staphylococcus aureus
atgacagcaacttgggaaaaaaaggaaggtaacgaaggtttattaactgttactgttcctgcagaaaaagtaaacaaagcgttagatcaagcattcaaaaaagtggttaaacaaattaacgtacctggattccgtaaaggtaaagtgccacgtccaatttttgaacaacgctttggtgtagaagcattatatcaagatgctatcgacattttattaccagatgcttatggtgaagcaattgacgaaactgatattaaaccagttgcacaaccagaagtaagtgttactcaaattgaaaaaggtaaagatttcatttttgaagcaacagttacagttgagccagaagttaaattaggagactataaaggtcttgaaattgaaaaacaagaaactgaattatctgatgatgagttacaagaagcgattgaccacagcttaggacatttagctgaaatggtcgttaaagaagatggtgttgttgaaaatggcgacacagttaacatcgactttagtggttcagttgacggagaagaattcgaaggtggacaagctgaaggttacgatttagaaatcggttcaggttcattcatacctggtttcgaagagcaattagaaggtatgaaagttgacgaagaaaaagatgttgtcgtaacattcccagaagaataccatgctgaagaattagccggtaaagaagcaactttcaaaacaaaagttaacgaaattaaatttaaagaagtcccagaattaacagatgaaattgctaatgaattagatgcagaagcaaatacagtagacgagtacaaagaaaacttacgtaaacgtttagctgaacaaaaagctacagatgctgaaaatgttgaaaaagaagaagcgattacaaaagctactgataatacaacaatcgatattcctgaagcaatggttaatactgaattagatcgtatggtgtctgaatttgcacaaagaattcaacaacaaggtttagatttacaaacgtacttccaaatctcaggtcaagatgaaactcaattaagagagcaaatgaaagacgatgcagaacaacgtgttaaaactaacttaactttaactgcgatcgctgaagctgaaaaaatcgaagctactgatgaagatatcgataaagaattagaaaaaatgagtaaacaatttaatatctcagttgaagatatcaaaaatactttaggtaatactgatatcattaaaaatgatgttcgtatccaaaaagttatcgatttattaagagataacgcaaagttcgttgaaggaactaaagaagat

SEQ ID NO: 5466 - protein, 433 aa, Staphylococcus aureus
  MISC_FEATURE (1)..(433): prolyl isomerase
MTATWEKKEGNEGLLTVTVPAEKVNKALDQAFKKVVKQINVPGFRKGKVPRPIFEQRFGVEALYQDAIDILLPDAYGEAIDETDIKPVAQPEVSVTQIEKGKDFIFEATVTVEPEVKLGDYKGLEIEKQETELSDDELQEAIDHSLGHLAEMVVKEDGVVENGDTVNIDFSGSVDGEEFEGGQAEGYDLEIGSGSFIPGFEEQLEGMKVDEEKDVVVTFPEEYHAEELAGKEATFKTKVNEIKFKEVPELTDEIANELDAEANTVDEYKENLRKRLAEQKATDAENVEKEEAITKATDNTTIDIPEAMVNTELDRMVSEFAQRIQQQGLDLQTYFQISGQDETQLREQMKDDAEQRVKTNLTLTAIAEAEKIEATDEDIDKELEKMSKQFNISVEDIKNTLGNTDIIKNDVRIQKVIDLLRDNAKFVEGTKED

SEQ ID NO: 5467 - DNA, 936 bp, Staphylococcus aureus
gtgacatatatgtcagatattattcagtttcctaactcttcgaaaaagttatataaagatataaaacgtgctgaacaagaccaaaactatgacctgatgtatgaatatattgtgcaatatgaacgtcaatttgaactcactgaagaaatagcaatgatgaaatgccgtatgttatatgagacggggtcatttcttgaattaagagaagaaacaattgtcttattgaaaactggcatacaacaatatgatgcattgatgatttattacgtgaaaagtttgattggtttgggacaatattttgaagcggtagaagtaattcatcaaattattgatgaagtcaaagatcacaaaacaagaatggcattacatcctcttaaagaatttgctaagtcaaaattaattgaagatgaaaaacgattgactcagtcattagctgattttgatacgttatcaatgagggaacagacgcacttgattttgaagttaatagacaatggtcattttcaatttcaagaaacggtattatatatattaaaatctaatacgtacagttataacctcattagtttaatgattgagtatttaaggttcgcaaattgtacacaagaactgacaattgaaaagtatggtatggatgtaacttttgtaccagctaatttaaaagggctagaacatacaacacttaaagaaaaagttatacctaacgttatggaaacattaaatgatggtgctttacatatcgctgaagaagcacaccatattatgaataatcactctatcatgatttatccaattgatattgaaactttgtttgaaacgaataaatggattaatgcatacgaatgttatttcaaaaatatgttaggacttaaatgtgaattacaaagtatcgatgcatttaattttattcagcaattagatttgaataataatagt

SEQ ID NO: 5468 - protein, 312 aa, Staphylococcus aureus
  MISC_FEATURE (1)..(312): hypothetical protein
VTYMSDIIQFPNSSKKLYKDIKRAEQDQNYDLMYEYIVQYERQFELTEEIAMMKCRMLYETGSFLELREETIVLLKTGIQQYDALMIYYVKSLIGLGQYFEAVEVIHQIIDEVKDHKTRMALHPLKEFAKSKLIEDEKRLTQSLADFDTLSMREQTHLILKLIDNGHFQFQETVLYILKSNTYSYNLISLMIEYLRFANCTQELTIEKYGMDVTFVPANLKGLEHTTLKEKVIPNVMETLNDGALHIAEEAHHIMNNHSIMIYPIDIETLFETNKWINAYECYFKNMLGLKCELQSIDAFNFIQQLDLNNNS

SEQ ID NO: 5469 - DNA, 357 bp, Staphylococcus aureus
atgatcagtaaaattgataaaaataaagtgcgtttaaaaagacatgctcgtgttcgtactaacttatcaggtacagctgaaaagccacgtttaaacgtatatcgttcaaacaagcatatctacgctcaaattattgatgataataaaggcgtaacattagctcaagcttcttcaaaagacagcgacattgctactacagcaactaaagttgaattagcaactaaagtcggtgaagcaattgctaaaaaagctgctgacaaaggcattaaagaaatcgtatttgaccgtggaggatatttatatcacggacgtgttaaagcattagctgaagcagcaagagaaagcggattagaattt

SEQ ID NO: 5470 - protein, 119 aa, Staphylococcus aureus
  MISC_FEATURE (1)..(119): 50S ribosomal protein L18
MISKIDKNKVRLKRHARVRTNLSGTAEKPRLNVYRSNKHIYAQIIDDNKGVTLAQASSKDSDIATTATKVELATKVGEAIAKKAADKGIKEIVFDRGGYLYHGRVKALAEAARESGLEF

SEQ ID NO: 5471 - DNA, 606 bp, Staphylococcus aureus
atgtctaaatttgatgaacaaatcattgtagtacctagagaaattatttttaataatgaaaagaatactttcaatgggtttttaaataagaataaaccagaaggtcaaaatatttttgatgcgctaagtcaatatgaagttaagcgacgcggcgatatggaagaggatccatcatataaacaactcatttcttattgtttacttgaaaatgagcatggcgagatattagtgtatgaacgattatctggcggtggagaagctcgattgcatggacaatcttcaataggtgtaggcggtcatatgaatgatgttccaggagcagaatctattaacgaagtattgagagttaatgcacagagagaattagaagaagaagtaggtttaagtgagcaagattcacaaaatatggaatatatcggttttattaatgacgataataatgaagtgggcaaggtacatattggtgttgtatttaaaatcactgtaagtacgaatgatgtagaagctaaagaaacagatactttacgaataaaatgggttgaaaaaggcaacatagagtcatatgatgatttcgaaacgtggagtgcattaatccttcaagattta

SEQ ID NO: 5472 - protein, 202 aa, Staphylococcus aureus
  MISC_FEATURE (1)..(202): conserved hypothetical
MSKFDEQIIVVPREIIFNNEKNTFNGFLNKNKPEGQNIFDALSQYEVKRRGDMEEDPSYKQLISYCLLENEHGEILVYERLSGGGEARLHGQSSIGVGGHMNDVPGAESINEVLRVNAQRELEEEVGLSEQDSQNMEYIGFINDDNNEVGKVHIGVVFKITVSTNDVEAKETDTLRIKWVEKGNIESYDDFETWSALILQDL

SEQ ID NO: 5473 - DNA, 354 bp, Staphylococcus aureus
atgccacgagttaaaggtggaacagtaacaagagcgcgtcgtaaaaaaacgattaaattagctaaaggttacttcggttcaaaacatacattatacaaagtagctaagcaacaagtaatgaaatcaggtcaatatgctttccgtgaccgtcgtcaacgtaaacgtgacttccgtaaattatggattacacgtatcaacgcagcagctcgtcaacatgaaatgagctactcacgtttaatgaacggtttgaaaaaagctggtatcgacattaaccgtaaaatgttatcagaaatcgcaatttctgacgaaaaagcatttgctcaattagtaactaaagctaaagatgctttaaaa

SEQ ID NO: 5474 - protein, 118 aa, Staphylococcus aureus
  MISC_FEATURE (1)..(118): 50S ribosomal protein L20
MPRVKGGTVTRARRKKTIKLAKGYFGSKHTLYKVAKQQVMKSGQYAFRDRRQRKRDFRKLWITRINAAARQHEMSYSRLMNGLKKAGIDINRKMLSEIAISDEKAFAQLVTKAKDALK

SEQ ID NO: 5475 - DNA, 198 bp, Staphylococcus aureus
atgccaaaaatgaaaactcaccgcggagcagctaaacgtgttaaaagaactgcttcaggtcaattaaaacgttcaagagctttcacatctcacttattcgcaaacaagagcactaaacaaaaacgtcaattacgtaaagctagattagtgtctaagagcgatatgaaacgtgtaaaacaattattagcatacaaaaaa

SEQ ID NO: 5476 - protein, 66 aa, Staphylococcus aureus
  MISC_FEATURE (1)..(66): 50S ribosomal protein L35
MPKMKTHRGAAKRVKRTASGQLKRSRAFTSHLFANKSTKQKRQLRKARLVSKSDMKRVKQLLAYKK

SEQ ID NO: 5477 - DNA, 555 bp, Staphylococcus aureus
ttggggcagaatttcgtaaaaattttggaggggtcaaccatagcaaaagatcaaactcaaatcaatgacaaaattcgtgcaaaagaattacgtttaatcggtcaagatggggaacaaattggtgttaaatcaaagcgtgaagctttaaaaatggctgaacgtgtagatttagacttagtggtcgttgcaccgaatgcgaaaccaccagttgcaagaattatggattacggtaaattcaaattcgaacaacagaaaaaagaaaaagaaatgaaaaagaaacaaaaaattatcaatgttaaagaaattcgtttaagtccaacaattgaggaacatgatttccaaacgaagttgaaaaacggacgtaaattcttaactaaaggcgataaatgtaaagtatctattcgtttcagagggcgtgccattacgcataaggaaattggtcaacgtgtgctagaaaaatatgcagatgaatgcaaagatatagcaacagttgaacaaaaacctaaaatggacgggcgtcaaatgtttatcatgttagcgccaacagctgaaaaa

SEQ ID NO: 5478 - protein, 185 aa, Staphylococcus aureus
  MISC_FEATURE (1)..(185): translation initiation
LGQNFVKILEGSTIAKDQTQINDKIRAKELRLIGQDGEQIGVKSKREALKMAERVDLDLVVVAPNAKPPVARIMDYGKFKFEQQKKEKEMKKKQKIINVKEIRLSPTIEEHDFQTKLKNGRKFLTKGDKCKVSIRFRGRAITHKEIGQRVLEKYADECKDIATVEQKPKMDGRQMFIMLAPTAEK

SEQ ID NO: 5479 - DNA, 1491 bp, Staphylococcus aureus
atgtcaaaagttcaaaatgaaagtaacaatgttgtcaaaaggggacttaaagatcgtcatatttctatgattgcgattgggggttgtattggtacaggtttatttgtaacttctggtggagcaattcatgatgcaggtgctttgggtgcattaataggatacgcaattatcggaataatggtatttttcttaatgacgtcacttggcgaaatggctacgtatttgccagtatcaggttcatttagtacatatgctacaagatttgttgatccatctttagggtttgcgcttggttggaactattggtttaactgggtagtgactgtagcagcagatattacgattgcagcacaagtcattcaatattggacaccattgcaaggcatacccgcttgggcatggagtgcgttgttcttagttataatttttagtctgaattcgttatcagttcgcgtctatggtgaaagtgaatactggttggcattgataaaagtggttacagttattgttttcattgcaattggtttattaacgattgtcggaatcatgggtggtcatgttgtaggattcgaaatatttaataaaggtgaaggtccaattcttggtggcaacttaggaggaagtttgttatcaattctaggtgtattcttaatcgctggtttctcattccaaggtactgagttaattggtattacggctggtgaatcagaaaatcctgaacgtgctgtgccgaaagcaattaaacaagtattctggagaattttattattttacattttagccatttttgttatcggtatgttaattccttatgatagtagtgcattaatggggggtagtgataatgtagcaacgtctccattcacattagtgtttaaaaatgctggatttgcgtttgcagcatcatttatgaatgcagtcattttaacgtctgtgttatcagcaggtaactcaggtatgtatgcttcaactcgaatgctatattcaatgagtaaagataaattagcgtttgaagcatttggtaaaacaaataaaaacggtgtgccatatatgtcgttactcgttacagcaatcattgtagtgataattttcgtattacaaagccttacaaaaggtgcatacgaatatatcgttgcagcaagtggtttaactggttttattgcttgggtaggtatagcagtaagtcattatcgatttagaagagcatttgataaacaaaattatgacaaatctaaattaaaatatactgctaaattattcccattcggaccattatttgctggctttttatgtattgtagtaattattggtcaagatgttgactttattaaaacaggagattttaattttagtcgcttcttaattacgtatatgggaattccagtatttttagcattctttatttatcataagcttcgatataaaacgaaaaaaattccattagaacaagtagatttacgtcaagacgtgtcaatggatgaaataaaaggt

SEQ ID NO: 5480 - protein, 497 aa, Staphylococcus aureus
  MISC_FEATURE (1)..(497): lysine specific permease
MSKVQNESNNVVKRGLKDRHISMIAIGGCIGTGLFVTSGGAIHDAGALGALIGYAIIGIMVFFLMTSLGEMATYLPVSGSFSTYATRFVDPSLGFALGWNYWFNWVVTVAADITIAAQVIQYWTPLQGIPAWAWSALFLVIIFSLNSLSVRVYGESEYWLALIKVVTVIVFIAIGLLTIVGIMGGHVVGFEIFNKGEGPILGGNLGGSLLSILGVFLIAGFSFQGTELIGITAGESENPERAVPKAIKQVFWRILLFYILAIFVIGMLIPYDSSALMGGSDNVATSPFTLVFKNAGFAFAASFMNAVILTSVLSAGNSGMYASTRMLYSMSKDKLAFEAFGKTNKNGVPYMSLLVTAIIVVIIFVLQSLTKGAYEYIVAASGLTGFIAWVGIAVSHYRFRRAFDKQNYDKSKLKYTAKLFPFGPLFAGFLCIVVIIGQDVDFIKTGDFNFSRFLITYMGIPVFLAFFIYHKLRYKTKKIPLEQVDLRQDVSMDEIKG

SEQ ID NO: 5481 - DNA, 1935 bp, Staphylococcus aureus
atggaacaaattaatattcaatttccagatggtaataaaaaggcgtttgataaaggtactactactgaagatatagcacaatcaattagtcctggattacgtaaaaaagctgttgccggcaaatttaacgggcaacttgtagatttaactaaaccgcttgaaactgatggatcaattgaaattgtgacaccaggtagtgaagaagcgttagaggtattacgtcattctactgcacatttaatggcacacgcgattaaaaggttatatggtaatgttaaatttggtgtaggtcctgtaatagaaggtggattctactatgacttcgacattgaccaaaacatctcatctgatgactttgaacaaattgaaaaaacaatgaaacaaatcgttaacgaaaatatgaaaatcgaacgaaaagtggtttcacgagatgaagtgaaagagttattcagcaatgatgaatacaaattagaattaatcgacgcgattcctgaagatgaaaatgtaacattatatagtcaaggtgattttactgatttatgtcgtggagttcacgttccatcaacagctaaaattaaagagtttaaactattatctacagcaggtgcatactggcgtggagatagtaacaacaaaatgttacaacgtatatacggtactgctttctttgataaaaaagaattgaaagcacatttacaaatgttagaagagcgtaaagaacgtgatcatcgtaaaattggtaaagagttagaactattcacaaatagccaattagttggtgctggtttgccattatggttacctaacggtgcaacaattagacgtgaaattgaacgttacattgttgataaagaagttagcatgggatatgaccacgtttatacaccagtacttgctaatgttgatttatacaaaacatctggtcactgggatcactatcaagaagatatgttcccaccaatgcagttagatgaaactgaatctatggtattacgtccaatgaactgtccacatcatatgatgatttatgcgaataaaccacattcatatcgtgaattacctatccgtatcgctgagctaggaacgatgcatagatatgaagcaagtggtgctgtatcaggattacaacgtgttcgtggtatgactttaaatgattcacatatctttgttcgacctgatcaaattaaagaagaattcaaacgcgttgtaaacatgattattgatgtgtataaagactttggtttcgaggattatagctttagattaagttatagagaccctgaagataaagaaaagtactttgatgatgatgatatgtggaataaagctgaaaatatgcttaaagaggcagcggatgagcttggcttatcgtacgaagaagcgattggtgaagcggcattctatggtccgaaactagatgttcaagttaaaacagcgatgggtaaagaagagacattatcaacagcacaacttgatttcttattaccagaacgttttgatttaacttatattggtcaagatggtgaacatcatcgtccagttgttattcatcgtggtgttgtatcaacaatggaacgatttgtagcatttttaactgaagaaactaaaggtgcattcccaacttggttagcgccaaaacaagttcaaatcattccagttaacgttgatttacattatgattatgcgcgccaattacaagatgaattgaaatctcaaggcgttcgtgtaagtattgatgaccgtaatgaaaaaatgggttataaaatcagagaagctcaaatgcaaaaaataccttatcaaatcgtagttggggataaggaagttgaaaataatcaagtgaatgtgcgtcaatatggatcgcaagaccaagaaacagttgaaaaagatgaatttatctggaatctagttgatgaaattcgtttgaaaaaacataga

SEQ ID NO: 5482 - protein, 645 aa, Staphylococcus aureus
  MISC_FEATURE (1)..(645): threonyl-tRNA synthetase 1
MEQINIQFPDGNKKAFDKGTTTEDIAQSISPGLRKKAVAGKFNGQLVDLTKPLETDGSIEIVTPGSEEALEVLRHSTAHLMAHAIKRLYGNVKFGVGPVIEGGFYYDFDIDQNISSDDFEQIEKTMKQIVNENMKIERKVVSRDEVKELFSNDEYKLELIDAIPEDENVTLYSQGDFTDLCRGVHVPSTAKIKEFKLLSTAGAYWRGDSNNKMLQRIYGTAFFDKKELKAHLQMLEERKERDHRKIGKELELFTNSQLVGAGLPLWLPNGATIRREIERYIVDKEVSMGYDHVYTPVLANVDLYKTSGHWDHYQEDMFPPMQLDETESMVLRPMNCPHHMMIYANKPHSYRELPIRIAELGTMHRYEASGAVSGLQRVRGMTLNDSHIFVRPDQIKEEFKRVVNMIIDVYKDFGFEDYSFRLSYRDPEDKEKYFDDDDMWNKAENMLKEAADELGLSYEEAIGEAAFYGPKLDVQVKTAMGKEETLSTAQLDFLLPERFDLTYIGQDGEHHRPVVIHRGVVSTMERFVAFLTEETKGAFPTWLAPKQVQIIPVNVDLHYDYARQLQDELKSQGVRVSIDDRNEKMGYKIREAQMQKIPYQIVVGDKEVENNQVNVRQYGSQDQETVEKDEFIWNLVDEIRLKKHR

SEQ ID NO: 5483 - DNA, 120 bp, Staphylococcus aureus
ttgtttgatgagaatatggttaataaattagatgattactacttcatttatggtatttgtaatgaatacccggatcaagaccgttatcttaagcagagatatttaatacataaattgtat

SEQ ID NO: 5484 - protein, 40 aa, Staphylococcus aureus
LFDENMVNKLDDYYFIYGICNEYPDQDRYLKQRYLIHKLY

SEQ ID NO: 5485 - DNA, 939 bp, Staphylococcus aureus
atgggaggaggacagtcaataatgaagcaatttaaaagtataattaacacgtcgcaggactttgaaaaaagaatagaaaagataaaaaaagaagtaatcaatgacccagatgttaagcaatttttggaagcgcatcgagctgaattaacgaatgctatgattgatgaagacttaaatgtgttacaagagtataaagatcaacaaaaacattatgacggtcataaatttgctgattgtccaaatttcgtaaaggggcatgtgcctgagttatatgttgataataaccgaattaaaatacgctatttacaatgcccatgtaaaatcaagtacgacgaagaacgctttgaagctgagctaattacatctcatcatatgcaacgagatactttaaatgccaaattgaaagatatttatatgaatcatcgagaccgtcttgatgtagctatggcagcagatgatatttgtacagcaataactaatggggaacaagtgaaaggcctttacctttatggtccatttgggacaggtaaatcttttattctaggtgcaattgcgaatcagctcaaatctaagaaggtacgttcgacaattatttatttaccggaatttattagaacattaaaaggtggctttaaagatggttcttttgaaaagaaattacatcgcgtaagagaagcaaacattttaatgcttgatgatattggggctgaagaagtgactccatgggtgagagatgaggtaattggacctttgctacattatcgaatggttcatgaattaccaacattctttagttctaattttgactatagtgaattggaacatcatttagcgatgactcgtgatggtgaagagaagactaaagcagcacgtattattgaacgtgtcaaatctttgtcaacaccatactttttatcaggagaaaatttcagaaacaat

SEQ ID NO: 5486 - protein, 313 aa, Staphylococcus aureus
  MISC_FEATURE (1)..(313): primosomal protein
MGGGQSIMKQFKSIINTSQDFEKRIEKIKKEVINDPDVKQFLEAHRAELTNAMIDEDLNVLQEYKDQQKHYDGHKFADCPNFVKGHVPELYVDNNRIKIRYLQCPCKIKYDEERFEAELITSHHMQRDTLNAKLKDIYMNHRDRLDVAMAADDICTAITNGEQVKGLYLYGPFGTGKSFILGAIANQLKSKKVRSTIIYLPEFIRTLKGGFKDGSFEKKLHRVREANILMLDDIGAEEVTPWVRDEVIGPLLHYRMVHELPTFFSSNFDYSELEHHLAMTRDGEEKTKAARIIERVKSLSTPYFLSGENFRNN

SEQ ID NO: 5487 - DNA, 534 bp, Staphylococcus aureus
atgagtcgtgttggtaagaaaattattgacatccctagtgacgtaacagtaacttttgatggaaatcatgtaactgttaaaggtcctaaaggtgaattatcaagaactttaaatgaaagaatgacattcaaacaagaagaaaacacaattgaagttgtaagaccatctgattctaaagaagatagaacaaaccatggtacaactcgtgctttattaaacaatatggtacaaggtgtttctcaaggatacgtaaaagtacttgaacttgttggtgtaggttaccgtgctcaaatgcaaggtaaagacttaatccttaacgttggttattctcacccagtagaaattaaagctgaagaaaacattactttctcagttgagaaaaacacagtcgttaaagttgaaggtatttcaaaagaacaagttggagcattagcatctaacatccgttcagtaagacctccagagccttacaaaggtaaaggtattcgttaccaaggtgaatacgttcgccgtaaagaaggtaaaactggtaaa

SEQ ID NO: 5488 - protein, 178 aa, Staphylococcus aureus
  MISC_FEATURE (1)..(178): 50S ribosomal protein L6
MSRVGKKIIDIPSDVTVTFDGNHVTVKGPKGELSRTLNERMTFKQEENTIEVVRPSDSKEDRTNHGTTRALLNNMVQGVSQGYVKVLELVGVGYRAQMQGKDLILNVGYSHPVEIKAEENITFSVEKNTVVKVEGISKEQVGALASNIRSVRPPEPYKGKGIRYQGEYVRRKEGKTGK

SEQ ID NO: 5489 - DNA, 1398 bp, Staphylococcus aureus
atgggacgacaagccttcgaattcggcttaagaccaaaggatcaattcaaagttatgcaacactttgatttaaatacgaatcatttagaggtattgaatcgactgtatacaccgctaattggaacgcaagcagtgggtttatatcattttatgactcaattcgttaaagaaagtcataatgaaacattgattctttctcattatatttttatgaatgaacttaaaattaatttactagagtttagacaacaaatggacttacttgaagcgattggattgttaaaggcgtttgtcaaacatgatgaacaagaaacacaatttgtttaccaattaattcaaccgccttcagcacatttattttttaatgatccaatgttgtcaatctttttatatagtgaagtcgagcatcgtcgatttcatgagttgaagaaatactttgagtatcaacaaattgatttgagtgaatttaaacaggtaacaagacaatttactgatgtttttaaagtgccgtctacaaaaatagatatcgatacaagtgatattccgattaatgaaccgtaccaaggtatcgatttatcaaatgaatcttttgactttgaaatgttgagacaaatgttaggtaaacattttattagtcaagacattgttaccaaagatgcaaagcgtttaattacacaactcgcgactttatatggtttaacagcagatggcatgaagcatgttattttaaattcaattacaagtggacaacagttatcctttgaagaaatgcgtaaacaagcacgctcgtattacttaatggaacacgaaaatcaaatgcctaaattacaggtgaaatctcctgctacatcatcttcggcgggcaaatcttcagaagtgaatccaaagccacaaagtgatgaatggtttgagttacttgaacaaacgagtccaattgatatgttagcttcttggtctgaatcagaaccaactatatcgcaaaagacaatggttgaagaattaattgaacgtgaaaaaatgtcttttggcgtcattaatattttgttgcaatttgtcatgttaaaagaagatatgaaacttcctaaagcgtatattttggaaatagcatcaaattggaagaaaaaaggtattaagacagctaaagaagcatataattacgctaaaaaagttaatcaacctaaaaatgagggttctagcggaaattaccaaaagcgtggttcatactatgggcagcgtaatcgtatttcaaaagaaaaaacacctaaatggttagaaaatagagataaacctagtgaagaagattcggctaaagataatagcgtagatgatcaacaattagagcaagatcgacaagcatttctagataaattatctaaaaaatgggaggaggacagtcaa

SEQ ID NO: 5490 - protein, 466 aa, Staphylococcus aureus
  MISC_FEATURE (1)..(466): chromosome replication
MGRQAFEFGLRPKDQFKVMQHFDLNTNHLEVLNRLYTPLIGTQAVGLYHFMTQFVKESHNETLILSHYIFMNELKINLLEFRQQMDLLEAIGLLKAFVKHDEQETQFVYQLIQPPSAHLFFNDPMLSIFLYSEVEHRRFHELKKYFEYQQIDLSEFKQVTRQFTDVFKVPSTKIDIDTSDIPINEPYQGIDLSNESFDFEMLRQMLGKHFISQDIVTKDAKRLITQLATLYGLTADGMKHVILNSITSGQQLSFEEMRKQARSYYLMEHENQMPKLQVKSPATSSSAGKSSEVNPKPQSDEWFELLEQTSPIDMLASWSESEPTISQKTMVEELIEREKMSFGVINILLQFVMLKEDMKLPKAYILEIASNWKKKGIKTAKEAYNYAKKVNQPKNEGSSGNYQKRGSYYGQRNRISKEKTPKWLENRDKPSEEDSAKDNSVDDQQLEQDRQAFLDKLSKKWEEDSQ

SEQ ID NO: 5491 - DNA, 468 bp, Staphylococcus aureus
atgaaatgcccgaaatgtaattctacacaatctaaagttgtagattcaaggcatgccgatgaattaaatgccattcgaagacgaagagaatgtgaaaattgtggaacacgtttcactacatttgaacatatcgaagttagtcagcttatagttgtgaaaaaagatggcacaagagagcagttttcaagagaaaagatacttaatggacttgtgcgttcttgtgagaaacgaccagttagatatcaacaacttgaagacataactaacaaggttgaatggcaattacgagatgaaggtcatacggaagtgtcttcacgagatataggtgaacacgttatgaacttgttaatgcatgttgatcaagtttcatatgttagatttgcatcagtctataaagaatttaaagatgttgatcaattgttagcatcgatgcaagggattttaagcgaaaacaaacggagtgatgct

SEQ ID NO: 5492 - protein, 156 aa, Staphylococcus aureus
  MISC_FEATURE (1)..(156): conserved hypothetical
MKCPKCNSTQSKVVDSRHADELNAIRRRRECENCGTRFTTFEHIEVSQLIVVKKDGTREQFSREKILNGLVRSCEKRPVRYQQLEDITNKVEWQLRDEGHTEVSSRDIGEHVMNLLMHVDQVSYVRFASVYKEFKDVDQLLASMQGILSENKRSDA

SEQ ID NO: 5493 - DNA, 1032 bp, Staphylococcus aureus
gtgcttttaatgtcaacgaatattgcaattaatggtatgggtagaattggaagaatggtattacgtattgcattacaaaataaaaatttaaatgtagtagcgataaatgctagttatccacccgaaacaattgcacatttaatcaattacgatacgacacatggaaaatataatctaaaagttgaaccgattgaaaatggattgcaagttggagatcataaaattaaattggttgctgatcgcaatcctgaaaacttgccatggaaagaattagatatcgatattgctatagatgcaactggtaaatttaatcatggtgataaagccatcgcacatattaaagcaggtgccaaaaaagttttgttaactggtccttcaaaaggtggacatgttcaaatggtagttaaaggcgtaaatgataaccaattagatatagaagcatttgacatttttagtaatgcttcatgtactactaattgcattggtccagttgcaaaagttttaaataatcagtttggaatagttaatggtttaatgactactgttcacgctattacaaatgaccaaaaaaatattgataatccacataaagatttaagacgtgcacgttcatgtaatgaaagcattattcctacttctactggtgcggcgaaagctttaaaagaagtattaccagaattagaaggtaaattacacggcatggcattacgtgtaccaacaaagaatgtatcgctcgttgatttagttgttgatttagaaaaagaagtaactgcagaagaagtaaaccaagcttttgaaaatgcaggtttagaaggtatcatagaagtcgaacatcaaccactagtgtctgttgattttaatactaatccaaattcagctattattgatgcaaaatcaacaatggtcatgtcagggaataaagtaaaagttattgcttggtatgataatgaatggggttattcaaatagagttgtagatgttgctgagcaaattggagcacttttgacatcaaaagaaactgtaagtgcaagt

SEQ ID NO: 5494 - protein, 344 aa, Staphylococcus aureus
  MISC_FEATURE (1)..(344): glyceraldehyde 3-phosphate
VLLMSTNIAINGMGRIGRMVLRIALQNKNLNVVAINASYPPETIAHLINYDTTHGKYNLKVEPIENGLQVGDHKIKLVADRNPENLPWKELDIDIAIDATGKFNHGDKAIAHIKAGAKKVLLTGPSKGGHVQMVVKGVNDNQLDIEAFDIFSNASCTTNCIGPVAKVLNNQFGIVNGLMTTVHAITNDQKNIDNPHKDLRRARSCNESIIPTSTGAAKALKEVLPELEGKLHGMALRVPTKNVSLVDLVVDLEKEVTAEEVNQAFENAGLEGIIEVEHQPLVSVDFNTNPNSAIIDAKSTMVMSGNKVKVIAWYDNEWGYSNRVVDVAEQIGALLTSKETVSAS

SEQ ID NO: 5495 - DNA, 621 bp, Staphylococcus aureus
atgccgaaagttattggtctaacaggtggaatcgcctcaggaaaatcaacagtatcagaactcttatccgtattcggttttaaagtagtagatgctgataaagcagccagggaagctgttaaaaaggggagtaaaggtttagctcaagtacgagaagtctttggtgatgaagcaattgatgaaaatggtgagatgaatcgtcgttatatgggtgatctagtgtttaatcatccagaaaaacgcttagaattaaatgctatcatacatcctatcgtgcgagatattatggaagaagaaaagcaagaatatttaaaacaaggatataatgtaatcatggatattccattattatttgaaaatgaattggaaaatgcagtagacgaagtgtgggttgtatacacttctgaaagtatacaaatggatcgtttaatgcaacgtaataatttgtcattagaagatgcgaaagcacgtgtctatagccaaatttctattgataaaaaaagccgaatggccgatcatgttatcgataatttaggggataaacttgaattaaaacaaaaccttgagagattgttagaagaagaaggttatattgaaaagccgaattacggagaagaagat

SEQ ID NO: 5496 - protein, 207 aa, Staphylococcus aureus
  MISC_FEATURE (1)..(207): conserved hypothetical
MPKVIGLTGGIASGKSTVSELLSVFGFKVVDADKAAREAVKKGSKGLAQVREVFGDEAIDENGEMNRRYMGDLVFNHPEKRLELNAIIHPIVRDIMEEEKQEYLKQGYNVIMDIPLLFENELENAVDEVWVVYTSESIQMDRLMQRNNLSLEDAKARVYSQISIDKKSRMADHVIDNLGDKLELKQNLERLLEEEGYIEKPNYGEED

SEQ ID NO: 5497 - DNA, 870 bp, Staphylococcus aureus
atgcccgaattaccagaagtagaacatgtaaaaagaggaattgaaccctacgttataaatcaaaaaattgaacacgttatattttcggataaagtaatcgaaggtaaagctcaaggcaaggaaacaattataaaaggaattgaattagatacttttaaaactttatcggaaggctataccattacaaatgtagaacgaagaagtaaatatatcgtttttcagctagataataaacgagaacaacgtacattaattagtcatttaggtatggcgggcggttttttcattgtagatgaacttgaagatattatgatacctaattatcgtaagcattggcatgttatttttgagttgtcaaatgacaaaaagttaatttattcagatatacgtcgttttggagaaattagaaatgttgcgtctgtagcatcttatccttcatttttagaaatagcgcctgaacctttttcaaatgaagcattgacgtattatttaaatcgaattcatcaacagtctaataagaataaaccaatcaaacaagtgattttggatcataaagtaatcgcaggttgtggaaatatttacgcatgtgaagcgttgtttcgtgcaggtgttttaccagataaaaaagtaaaagacttaacacaccaacaacaagaaatggttttttattatgttagagaagtactagaagaaggtattaaatatggcggtacaagtatttcagattatcgtcatgctgatggaaaaactggtgagatgcaattgcatcttaatgtatataagcagccggtatgcaaagtgtgtggaagtcaaattgaaacaaaaatcatcgcgacaagaaatagtcattattgtccagtatgtcaaaaa

SEQ ID NO: 5498 - protein, 290 aa, Staphylococcus aureus
  MISC_FEATURE (1)..(290): hypothetical protein
MPELPEVEHVKRGIEPYVINQKIEHVIFSDKVIEGKAQGKETIIKGIELDTFKTLSEGYTITNVERRSKYIVFQLDNKREQRTLISHLGMAGGFFIVDELEDIMIPNYRKHWHVIFELSNDKKLIYSDIRRFGEIRNVASVASYPSFLEIAPEPFSNEALTYYLNRIHQQSNKNKPIKQVILDHKVIAGCGNIYACEALFRAGVLPDKKVKDLTHQQQEMVFYYVREVLEEGIKYGGTSISDYRHADGKTGEMQLHLNVYKQPVCKVCGSQIETKIIATRNSHYCPVCQK

SEQ ID NO: 5499 - DNA, 2628 bp, Staphylococcus aureus
gtgaataaattagtattaatcgatggtaatagcttaagttttagagctttttatgcattacctttgttatcaaacaaagcaggcattcataccaatgcagtatatggttttgcaatgttactagagaagattttaaaagaagaaaagccaaatcattttttagtagcgtttgatgcaggtaaaacgactttcagacatgaaaaatatagtgaatataaaggtggacgccagaaaacgccgcctgaactaagtgagcaatttccttatattcgccaattattagatgcttatcatattaaacgttatgaattagataactatgaggcagatgatattatcggaactttaagtaaagaagcagataaagcgggctttcagacaattattattacgggagaccgagatttaacacaacttgcaacggataatgtaaccatttattacactaaaaaaggtgttactgatgttgatcattatacacctgactttattgcggaaaaatacaacgggttaacacctaatcaaattattgatatgaaaggattaatgggagatacttctgataatataccaggtgttgcaggtgttggagagaaaacagcaataaaattgctaaaccaatttgacacagtagaaggtgtctatgaacatttagatgaaatttcaggtaaaaagttaaaagaaaaacttcaaaatagcaaagaagatgcattaatgagtaaagaattagcaacgattaatgtagatagtccgattgaagtaaaacttgaagatacgttaatgactcatcaagatgaacaacaagaaaaaatcgaattgtttaagaagttagaattcaaacaattgttggctgacattgatcaatcagcaagcgttgaagatgcaatagaaaagacatttgaaattgaaacgtcttttgataatattgattttacttcattgaaagaagcggccatccatttcgaattagacggtggtaactatttgcgaaataatattttaaaattctctttatttacaggtgagaaacatattgtaattaatgcggatgacataaataattatgtcgaactagtttcatggttagaaaatccgaattcgaaaaaagtcgtatatgatgctaaaaaaacatatgtagcatcacatagattggggattgatattcaaaatatttctttcgatattatgttggccagttatataattgatccatctcgtacgattagtgatgttcaatcagttgtttcattgtacggtcaaagttttgtgaaagacgatgtgagtatatatggaaaaggtaagaaatttaaggtacctgaagatgatgttttaaatccatatgttgcttctattactgatgcaatttactttgcgaaaccaaatatggataaacaattagaagaatacaatcaggtagaactcttggctgatttagagctaccgctagctaagattttaagtgaaatggaagaaattggtatatttacagatgttcatgatttagaagaaatggaaaaagaaattcaagaaaaattagacgtcttgattcgaaatatccatgatgcagctggtgaagattttaatataaattctcctaagcaattaggtgttgtattgtttgagacattacaattacctgttattaaaaagacgaaaacaggatattctactgctgtagatgtcttagagcaattgcaaggtgaacatcctatcattgattatattttagaatatcgtcaattatctaagttacagtctacttatgttgaaggattgcaaaaggtaattagtgatgatcaacgtatccatacacgttttaatcaaactttagcgcaaactggacgtttatcaagtgtagatcctaatttacaaaatattccggttagacttgaagaagggcgtaaaataagaaaagcctttaaaccaacttcaaaagatagcgttatattatcagcagattattctcaaattgaattgcgtgtattagcacacattacacaagatgagagtatgaaagaagcatttatcaacggcgatgatattcatacagcaactgctatgaaagtatttggtgtagaagctgatcaagtcgatagtttaatgcgtcgtcaagcaaaagcagttaactttggaattgtttatgggataagtgattatggtttaagtcaaagtttaggtattactcgtaaaaaagcaaaagcattcattgatgattatttagctagtttcccaggtgtaaaacaatatatgtctgatattgtaaaagatgccaaagctttaggttacgtggaaacattgctacatcgtcgacgctatattcctgatattacgagtcgtaactttaatttacgcggctttgctgaacgtactgctatgaatacgccaatacagggcagtgctgcagatatcattaaactggcaatggttaaatttgctcaaaaaatgaaagagacaacatatcaagctaaactattattacaagtacacgatgaattaatttttgaagtacctaagtcagaagtagattcatttagtgaatttgtagaagagataatggaaaatgcattgcaattagatgttccattaaaagtagactcaagttatggtgcaacctggtatgatgcaaaa

SEQ ID NO: 5500 - protein, 876 aa, Staphylococcus aureus
  MISC_FEATURE (1)..(876): DNA polymerase I
VNKLVLIDGNSLSFRAFYALPLLSNKAGIHTNAVYGFAMLLEKILKEEKPNHFLVAFDAGKTTFRHEKYSEYKGGRQKTPPELSEQFPYIRQLLDAYHIKRYELDNYEADDIIGTLSKEADKAGFQTIIITGDRDLTQLATDNVTIYYTKKGVTDVDHYTPDFIAEKYNGLTPNQIIDMKGLMGDTSDNIPGVAGVGEKTAIKLLNQFDTVEGVYEHLDEISGKKLKEKLQNSKEDALMSKELATINVDSPIEVKLEDTLMTHQDEQQEKIELFKKLEFKQLLADIDQSASVEDAIEKTFEIETSFDNIDFTSLKEAAIHFELDGGNYLRNNILKFSLFTGEKHIVINADDINNYVELVSWLENPNSKKVVYDAKKTYVASHRLGIDIQNISFDIMLASYIIDPSRTISDVQSVVSLYGQSFVKDDVSIYGKGKKFKVPEDDVLNPYVASITDAIYFAKPNMDKQLEEYNQVELLADLELPLAKILSEMEEIGIFTDVHDLEEMEKEIQEKLDVLIRNIHDAAGEDFNINSPKQLGVVLFETLQLPVIKKTKTGYSTAVDVLEQLQGEHPIIDYILEYRQLSKLQSTYVEGLQKVISDDQRIHTRFNQTLAQTGRLSSVDPNLQNIPVRLEEGRKIRKAFKPTSKDSVILSADYSQIELRVLAHITQDESMKEAFINGDDIHTATAMKVFGVEADQVDSLMRRQAKAVNFGIVYGISDYGLSQSLGITRKKAKAFIDDYLASFPGVKQYMSDIVKDAKALGYVETLLHRRRYIPDITSRNFNLRGFAERTAMNTPIQGSAADIIKLAMVKFAQKMKETTYQAKLLLQVHDELIFEVPKSEVDSFSEFVEEIMENALQLDVPLKVDSSYGATWYDAK

SEQ ID NO: 5501 - DNA, 1500 bp, Staphylococcus aureus
ttgaggattagcaaagtgaaaacaattcaattacacaagacaactttgatattaattgcgatattattgttttatacttttatgggtatcttactaccactcatgcacgatgatttacaatggtttagcaattataatactgatattttaaaagtaggatttgcatcacttaatggtcgctatatcggaaatatctttgaaattatagctgtacatgtaagctggttacgttggctttcatatggcctcattagtatgggcatcatttggatgattatgcacattacacgttgtaaagcgtggacaagctattatttgttagcattttctttaatgttaattttaccaagtgctatttatgcagatacatatggctggtttgcaggattttataattatgcgacatcaacactaatttcactctttattatttattattgtattaatgcaattatatataaagaaaagcagccggtaagtgttactgtactattctatgttttatgcttcttcggtcaattatttatggagaatgtgacattattccactgtatcattttaattttagcttttctgtatgaatttactgcaaatcgaacacttaattataaattattgttttcatttatgattgctactataggtacaatcattatgttttccaatccaaattatcgcaaaattttatttgaaggatcagaatatcaacaagtttcaaataatcaaggtatcttttcaaaatttgcagaaatgatatcaacgtcacttccatatggtgtcattttcagtcagattataattttaagtatgattgcagcgcttattatttatctactgcttagaagtgatcggtatgtacatttaacaatattaaagcgtcgtatcattatgataggatttatcactttaccgctttattatttactattttacaatcagtttttattaaataaaaatacagatattggattggttggttttgtgaacgtaattgtatgtggttactttgcgttttcgatatttgtaggtatttatttgtctattaatgatcgtaaaacacaaatcactttatattccttacttattgcaatatgtgtttcggcgtcgacactagtcattgttactccaatagaaccaggtaattttttgattgtttatacgatacatgtaatcattttaattattttattaaaagaatttcggaaatataagtcaatcaatgttaattttattaaaggtgcatcactagttttagctgtgatatatcttagtgcatttatttatgttcattatgaacatgaaaaaagagttcagttattaaaacaacaaattaaagatcatccacgacaagaggtttatacagtggaatcattgccgtttgaacattatatgcatcatccgtcaccaatcaataaaaattaccaagagtggtttaataattatgaagaattaccgaaaatgaccaaagttaaatatattccatttggttcagacgattca

SEQ ID NO: 5502 - protein, 500 aa, Staphylococcus aureus
  MISC_FEATURE (1)..(500): hypothetical protein
LRISKVKTIQLHKTTLILIAILLFYTFMGILLPLMHDDLQWFSNYNTDILKVGFASLNGRYIGNIFEIIAVHVSWLRWLSYGLISMGIIWMIMHITRCKAWTSYYLLAFSLMLILPSAIYADTYGWFAGFYNYATSTLISLFIIYYCINAIIYKEKQPVSVTVLFYVLCFFGQLFMENVTLFHCIILILAFLYEFTANRTLNYKLLFSFMIATIGTIIMFSNPNYRKILFEGSEYQQVSNNQGIFSKFAEMISTSLPYGVIFSQIIILSMIAALIIYLLLRSDRYVHLTILKRRIIMIGFITLPLYYLLFYNQFLLNKNTDIGLVGFVNVIVCGYFAFSIFVGIYLSINDRKTQITLYSLLIAICVSASTLVIVTPIEPGNFLIVYTIHVIILIILLKEFRKYKSINVNFIKGASLVLAVIYLSAFIYVHYEHEKRVQLLKQQIKDHPRQEVYTVESLPFEHYMHHPSPINKNYQEWFNNYEELPKMTKVKYIPFGSDDS

SEQ ID NO: 5503 - DNA, 1662 bp, Staphylococcus aureus
atgatgaagtttcaccaccgcttaatgttattgataagcagtatattaattatcagttttgttacattaggcattattattcacgcttccatcacatatgttttatcagaaaaacacgaacaagctctagcaacagatgcaagatcatatatttatttagtccaagataatgagattgataaagttaaaaaaattgtaaaacagcaaaatatagatttattgataactaagcatgataaaaaggtgtttagtagtggcaaactgaaagctatcccaaatagtgatagctatattcaaaaaagggacgtttttatttttaataagaaggttaacggttatcatgtatggattaaaggttacaataacgatattacagaaatgcattggacgttgtggaaatatcttattttgacatgtttagttgtactcatttgtctgtattttgcaagccgtagttttaagcgtacattaatccgtcccattcaagaagttacttatgcaacacaattgttggcaaatggttattatcacatacgtgtacctgaaagtaatgttgtagaaactaaagcgctttttgtgtctaccaatgatttagcacgacgccttcaaaagcttaataatgagcaaaaaattcaatccaaccgtttaaaaacaacgattgaaaatattccaagtgctattttaatgatagatcgaaatggaaaaatcgttgttgcaaataaagcgtattatgaacagttcaacatctcgcataatattgaacaagtaggctatcacggctatgttaatactgaaattgagcaattaattttagaaagttttaaagttgaaaaacctatttatgaacaattggaagttgcaataaaccaagtccatgccaagtactttgatatttcatgcgttccgattttaactaggtctcaaaaaagtttgcaagggattttagttgtgatgcatgatataacaaatctgaaacaacttgaaaatctaagacgtgaatttgtagcaaatgtttcacatgaattaaaaacacctattacttcaattaaggggtttgctgaaacgcttattgatggtgcaaaaaatgatgcggaatcattagacatgtttttaaacataattttaaaagaatcaaatcgaatagaatctttagtaacagatctgttagatttatcgcatattgagcaacatacagagttagatacagactatatgaatttatcagatttaacgcggcgtattattgataatatgatgactcaagccaatcaaaaaaatatttccattcatactgatattgaaaaagatgtcattgttaaagcacaagaaagtaaaattgctcaagttatcacgaatttgttaacgaatgcaattaactattcttatgaagatggagatattaacgttcgtgtgtatcgagatgactttcgtgtcattttcgaagtacaagattttggtataggtattaaattagaagaccaacaacgtatttttgaaagattttatagagtagataaagcacgaagtagagattctggtgggacaggtcttggattatcaattacaaagcatatagtagaggcccaccaaggcaatattgaagtgaatagtcaagttggcaaaggctcaacgttcaaagttattctaaaagattataaagaa

SEQ ID NO: 5504 - protein, 554 aa, Staphylococcus aureus
  MISC_FEATURE (1)..(554): alkaline phosphatase
MMKFHHRLMLLISSILIISFVTLGIIIHASITYVLSEKHEQALATDARSYIYLVQDNEIDKVKKIVKQQNIDLLITKHDKKVFSSGKLKAIPNSDSYIQKRDVFIFNKKVNGYHVWIKGYNNDITEMHWTLWKYLILTCLVVLICLYFASRSFKRTLIRPIQEVTYATQLLANGYYHIRVPESNVVETKALFVSTNDLARRLQKLNNEQKIQSNRLKTTIENIPSAILMIDRNGKIVVANKAYYEQFNISHNIEQVGYHGYVNTEIEQLILESFKVEKPIYEQLEVAINQVHAKYFDISCVPILTRSQKSLQGILVVMHDITNLKQLENLRREFVANVSHELKTPITSIKGFAETLIDGAKNDAESLDMFLNIILKESNRIESLVTDLLDLSHIEQHTELDTDYMNLSDLTRRIIDNMMTQANQKNISIHTDIEKDVIVKAQESKIAQVITNLLTNAINYSYEDGDINVRVYRDDFRVIFEVQDFGIGIKLEDQQRIFERFYRVDKARSRDSGGTGLGLSITKHIVEAHQGNIEVNSQVGKGSTFKVILKDYKE

SEQ ID NO: 5505 - DNA, 702 bp, Staphylococcus aureus
atgtcgcaaaaagtgttggtagtagatgacgaacattcaatcgtaacattacttaaatataacttagaaacagctggttatgaagttgttgtcgcatttgatggtgatgaggctttagaaaaggtagaaagtgaacagccagatttaattattttagatgttatgctacctaaaaaagatggcattgacgtatgtaagactgtaagaacaaataaaaatttagtccctatattaatgttaacggcgaaaaatgatgaatttgatcgggtattaggtttagaattaggtgccgatgactatatgactaagcctttttcacctagagaagttgttgcccgtgtgaaagccattttaagacgttctcaatttgtaaaagaagtagaagagattgacgatgatattaccatcggatcgatacgtattagacccgattattttgaagtatataagcataatgagttattggagctaacaccgaaagaatttgaactcttgctttatttgatagaaagacaaggcagagtcattacgagagagcatatgttaaatacggtatggaattatgaatttgcaggagactcaagaattgttgatgtacatatcagtcatttaagagataaattagaagataatcctaagaagccacaacttattaaaactgtgcgtggcttaggctataaattggaaagacctaaagaacaa

SEQ ID NO: 5506 - protein, 234 aa, Staphylococcus aureus
  MISC_FEATURE (1)..(234): alkaline phosphatase
MSQKVLVVDDEHSIVTLLKYNLETAGYEVVVAFDGDEALEKVESEQPDLIILDVMLPKKDGIDVCKTVRTNKNLVPILMLTAKNDEFDRVLGLELGADDYMTKPFSPREVVARVKAILRRSQFVKEVEEIDDDITIGSIRIRPDYFEVYKHNELLELTPKEFELLLYLIERQGRVITREHMLNTVWNYEFAGDSRIVDVHISHLRDKLEDNPKKPQLIKTVRGLGYKLERPKEQ

SEQ ID NO: 5507 - DNA, 1266 bp, Staphylococcus aureus
atgactgcagaaaaaattactcaaggaactgaaggattaaacgtacctaatgaaccaattatcccatttattatcggtgatggaattggaccggatatttggaaggcagcaagccgagttatagatgctgctgttgagaaagcctataatggcgaaaaacgcattgaatggaaagaagtgctagctggccaaaaagcatttgatacaactggtgaatggttacctcaagaaacacttgatacaattaaagaatatttaattgctgttaaaggacctttaacaacaccaattggtggtggtattagatcattaaatgtggctttacgccaagaattagatttatttacttgcttaagaccggtacgttggtttaaaggagtaccatcacctgttaaacgtccacaagatgttgatatggttattttccgtgaaaatactgaagacatttatgctggtattgaatttaaagaaggtacaacagaagttaaaaaggtaattgacttcttacaaaacgaaatgggtgcgacaaacattcgattcccagaaacttcaggtattggtattaaaccagtttctaaagaaggaactgagcgattagttagagcagctatacaatatgctatcgataataaccgtaaatcagttactttagttcataaaggtaatattatgaaatttacagaaggctcatttaagcagtggggttacgatttagcattatctgaatttggtgatcaagtattcacttggcaacaatatgacgaaattgttgaaaatgaaggcagagatgctgctaatgctgctcaagaaaaagctgaaaaagaaggcaagattatcattaaagattctattgctgacattttcttacaacaaattttaactcgtccagctgagcatgatgttgtagcaactatgaacttgaatggtgactatatttcagatgctttagctgcacaagttggtggtattggtattgcgccaggtgcaaacattaattatgaaacaggtcatgctatttttgaagcaacacatggtacagctccaaaatatgcaggtttaaataaagtgaatccatcttcagtaattttaagttctgtattaatgttagaacatttaggatggcaagaagcggcagataagattacagattcaattgaagatacaattgcttcaaaagttgttacttatgactttgcccgtttaatggatggtgctgaagaagtttctacatcagcatttgcagatgaattgattaaaaatttaaaa

SEQ ID NO: 5508 - protein, 422 aa, Staphylococcus aureus
  MISC_FEATURE (1)..(422): isocitrate dehyrogenase
MTAEKITQGTEGLNVPNEPIIPFIIGDGIGPDIWKAASRVIDAAVEKAYNGEKRIEWKEVLAGQKAFDTTGEWLPQETLDTIKEYLIAVKGPLTTPIGGGIRSLNVALRQELDLFTCLRPVRWFKGVPSPVKRPQDVDMVIFRENTEDIYAGIEFKEGTTEVKKVIDFLQNEMGATNIRFPETSGIGIKPVSKEGTERLVRAAIQYAIDNNRKSVTLVHKGNIMKFTEGSFKQWGYDLALSEFGDQVFTWQQYDEIVENEGRDAANAAQEKAEKEGKIIIKDSIADIFLQQILTRPAEHDVVATMNLNGDYISDALAAQVGGIGIAPGANINYETGHAIFEATHGTAPKYAGLNKVNPSSVILSSVLMLEHLGWQEAADKITDSIEDTIASKVVTYDFARLMDGAEEVSTSAFADELIKNLK

SEQ ID NO: 5509 - DNA, 1044 bp, Staphylococcus aureus
ttgacttatgccggctatgatattgatgatctagctgaaaatgcgcaatttgaagaagttattttcctattatggaactatagattgccaaacgaagaagagcttgctcatctaaaagggaaattaaatcaatacatgacattaaatcctcgtgtgtatacacattttgaggagtatgttacagatcacgtgcatccaatgacagcattacgtacgtcattatcatatattgcacatttcgatcctgatgctgaaaatgaatcagatgaaaatcgttatgaaagagcaatgcgtatacaggctaaagtagcatcattagttacagcgtttgctcgagtaagacaagataaagaaccacttaagcctaatcctgacttaagttatgcggcaaacttcctatatatgttacgtggggaattaccaacagatatagaagtagaagccttcaataaagcacttattttacacgctgatcatgagttgaacgcatctgcatttacggcacgttgtgcggtatcatcattgtcagatatgtactcaggtattgtagcagccgtaggttctctgaaagggccattacatggtggtgcaaacgaacaagttatgacgatgttatctgagattgggtcaattgaaaatgttgatgcttacttagatgaaaaatttgctaataaagataaagtaatgggcttcggtcatcgtgtatataaagatggtgatcctagagcgaaatatttaagagaaatgagccgtcaaattacgaaagacgctggtcgtgaagaattatttgaaatgtcagtgaaaatggaaaaacgtatggcagaagaaaaaggattaattcctaatgttgatttttatagtgcgagtgtttatcactgtatggaaatacctcatgacttattcacgccaatctttgctgtaagtcgttctgcaggatggattgctcatattttagaacaatataaagataatagaattatgcgtcctagagcgaaatatattggcgaaacgaatcgtaagtatatcccgcttgaagaaagaaaa

SEQ ID NO: 5510 - protein, 348 aa, Staphylococcus aureus
  MISC_FEATURE (1)..(348): citrate synthase II
LTYAGYDIDDLAENAQFEEVIFLLWNYRLPNEEELAHLKGKLNQYMTLNPRVYTHFEEYVTDHVHPMTALRTSLSYIAHFDPDAENESDENRYERAMRIQAKVASLVTAFARVRQDKEPLKPNPDLSYAANFLYMLRGELPTDIEVEAFNKALILHADHELNASAFTARCAVSSLSDMYSGIVAAVGSLKGPLHGGANEQVMTMLSEIGSIENVDAYLDEKFANKDKVMGFGHRVYKDGDPRAKYLREMSRQITKDAGREELFEMSVKMEKRMAEEKGLIPNVDFYSASVYHCMEIPHDLFTPIFAVSRSAGWIAHILEQYKDNRIMRPRAKYIGETNRKYIPLEERK

SEQ ID NO: 5511 - DNA, 1359 bp, Staphylococcus aureus
atggctgaaaaattacaaagggaactgagcaatcgccacatacaattaattgcaattggcggtgcaattggtacaggcttattcttaggtgctggtcaaacgattgcattaaccggcccttcaattctattaacatacatcattataggatttatgttatttatgtttatgcgaggtttaggagaaatcattatacagaatactgaatttaaatctttcgcagatgtaaccaatacatatattgggccttttgcaggatttgttaccggatggacatactggttctgttggattattacaggtatggctgaagtaacggctgtggcaaaatatgttagcttttggttcccagaaattccaaactggataagtgcactattttgtgtactgttattaatgtcattcaacctacttagcgcaagacttttcggagaattagaattttggttctctatcattaaaatagcgacaattattggtttaatagtagttggtttcgtcatgattctatttgcatttaaaactcaattcgggcatgccagtttcacaaatctatatgaacacggcatattcgctaaaggtgcttctggattctttatgtctttccaaatggcactattctcatttgtaggaattgaaatgattggtgttacagctggggaaacaaaagatccagttaaaacaattccaaaagcaattaacagtgtacccattagaattttaatattttacgttggggcgttagcggttatcatgtctattatcccttggcagcaagttgatcctgataacagtccattcgtaaaattattcgcattgatcggaattccgtttgctgcgggcttgattaattttgtagtattaaccgctgctgcttcatcatgtaacagtggtatattctcaaatagccgtatgcttttcggtttatcaagtcaacaacaagcacctccgaacttttctaagacgaataaatatggcgttccacatgttgcaatctttgcttcatcagcattattacttgtggcagcattactaaactatattttcccagatgcgacaaaagtatttacgtatgtgactaccatctctacagtgttatttttagttgtatggggtctgattatcattgcatatatcaattatagtcgtaaaaacccagatctacataaaaatgctacgtacaaactattaggtggcaaatatatgggctacttaatatttgtattcttcatttttgtgttcgggttattatttattaatgttgatacaagacgtgcaatttattttattccgatttggtttatacttttagcatttatgtacttaagatataaacgtatcgctgctaaatcaaataaa

SEQ ID NO: 5512 - protein, 453 aa, Staphylococcus aureus
  MISC_FEATURE (1)..(453): D-serine/D-alanine/glycine
MAEKLQRELSNRHIQLIAIGGAIGTGLFLGAGQTIALTGPSILLTYIIIGFMLFMFMRGLGEIIIQNTEFKSFADVTNTYIGPFAGFVTGWTYWFCWIITGMAEVTAVAKYVSFWFPEIPNWISALFCVLLLMSFNLLSARLFGELEFWFSIIKIATIIGLIVVGFVMILFAFKTQFGHASFTNLYEHGIFAKGASGFFMSFQMALFSFVGIEMIGVTAGETKDPVKTIPKAINSVPIRILIFYVGALAVIMSIIPWQQVDPDNSPFVKLFALIGIPFAAGLINFVVLTAAASSCNSGIFSNSRMLFGLSSQQQAPPNFSKTNKYGVPHVAIFASSALLLVAALLNYIFPDATKVFTYVTTISTVLFLVVWGLIIIAYINYSRKNPDLHKNATYKLLGGKYMGYLIFVFFIFVFGLLFINVDTRRAIYFIPIWFILLAFMYLRYKRIAAKSNK

SEQ ID NO: 5513 - DNA, 819 bp, Staphylococcus aureus
atgaaggaagaccatatgaaaaatggccaacttaagccaggatacaatttacaaatagcgacaaattctcaatttgttttatcctatgacctatttcaaaacccaacagatactagaacattaatcccatttttaacaatgattcaaaataccttcggttatttaccagagtatattgtagctgatgcaggttatggtagtgagcaaaactatatggctattatagatgattttaataaaacgccacttattacgtatggcatgtttattaaagataaaactagaaagtttaaaagtggcattttcaacactcaaaattggaaatatgacgaacttaataatgaatttatatgtcctaataacaaaagaataggttttaaaagatatgcataccgtaatgatagatatggttttaaacgagacttcaaactatatgaatgtgatgactgttcatcatgttctttgagacatcaatgcatgaaaccaaattcgaaatccaataagaaaatcatgaagaattataattgggaatactttaaagtccaaattaatcaaaagctttctgaaccagaaacgaaaaacatctatagtcaaagaaaaattgatgtagagcctgcttttggatttatgaaggctattttgggtttcactcgaatgtcagttcgaggaataaataaagttaaacgagagctaggttttgtattgatggcacttaatataaggaaaatagcagctcaacgagctgtacattataaaatacatatcaaaaaagctgatttctatcaaataattaatagaaatcagcttttttacattgcc

SEQ ID NO: 5514 - protein, 273 aa, Staphylococcus aureus
  MISC_FEATURE (1)..(273): truncated transposase
MKEDHMKNGQLKPGYNLQIATNSQFVLSYDLFQNPTDTRTLIPFLTMIQNTFGYLPEYIVADAGYGSEQNYMAIIDDFNKTPLITYGMFIKDKTRKFKSGIFNTQNWKYDELNNEFICPNNKRIGFKRYAYRNDRYGFKRDFKLYECDDCSSCSLRHQCMKPNSKSNKKIMKNYNWEYFKVQINQKLSEPETKNIYSQRKIDVEPAFGFMKAILGFTRMSVRGINKVKRELGFVLMALNIRKIAAQRAVHYKIHIKKADFYQIINRNQLFYIA

SEQ ID NO: 5515 - DNA, 825 bp, Staphylococcus aureus
atgtataaaatttataacatgacccaacttacactaccaatagaaacctctgttagaattcctcaaaatgatatttcgcgatatgttaatgaaattgttgaaacgatacctgatagcgaattcgatgaattcagacatcatcgtggcgcaacatcctatcatccaaaaatgatgttaaaaatcatcttatatgcatatactcaatctgtattttctggtcgtagaatagaaaaattacttcatgacagtattcgaatgatgtggttagctcaagatcaaacaccttcttataaaactattaatcgttttagagtgaatcctaatactgatgcgttaattgaatctttatttattcagttccatagtcaatgtttaaagcaaaatcttattgataataattcaatttttattgatggtacaaaagtagaagctaatgccaatagatatacatttgtgtggaagaaaagtattcaaaatcacgaatcgaaattgaacgaaaattcaaaaacattatatcgtgacttagttgaagaaaaaataataccagagataaaagaagatggagatagcgatttaacaatagaagaaatagatttaattggtagtcatttagataaagaaatcgaagatttaaatcattctattgagaacgaagattgtgctcaaattagaaaacagacccgtaaaaaaataactgagattaagaagttcaaaaagaaatttgatgattattccgaaagaaaaaataaatatgaagaacaaaaatcgattcttaaagatagaaatagtttttctaaaactgatctgatcatgatgcaactttta

SEQ ID NO: 5516 - protein, 275 aa, Staphylococcus aureus
  MISC_FEATURE (1)..(275): truncated transposase
MYKIYNMTQLTLPIETSVRIPQNDISRYVNEIVETIPDSEFDEFRHHRGATSYHPKMMLKIILYAYTQSVFSGRRIEKLLHDSIRMMWLAQDQTPSYKTINRFRVNPNTDALIESLFIQFHSQCLKQNLIDNNSIFIDGTKVEANANRYTFVWKKSIQNHESKLNENSKTLYRDLVEEKIIPEIKEDGDSDLTIEEIDLIGSHLDKEIEDLNHSIENEDCAQIRKQTRKKITEIKKFKKKFDDYSERKNKYEEQKSILKDRNSFSKTDLIMMQLL

SEQ ID NO: 5517 - DNA, 1755 bp, Staphylococcus aureus
atgagaaaaactaaaattgtatgtacaattggaccagcttcagaatcagaagaaatgattgagaaattaatcaatgctggtatgaacgttgcacgattaaacttttcacatggtagtcatgaagagcataaaggtagaattgatacaattcgtaaagtagctaaaagattagacaaaattgtagcaattttattagatacaaaaggtccagaaattcgtacgcataatatgaaagacggtatcattgaacttgaacgtggcaacgaagttattgttagcatgaatgaagttgaaggaacacctgaaaagttctcagtaacatatgaaaacttaattaacgatgttcaagtaggttcatacattttacttgatgatggcttaattgaattacaagttaaagatattgaccatgctaaaaaagaagttaaatgtgatattttaaactctggtgagcttaaaaacaaaaaaggtgttaacttacctggcgtaagagtaagtttacctggtattacagaaaaagatgctgaagatatccgtttcggtattaaagaaaatgttgacttcattgcagcaagtttcgtacgtcgtcctagtgatgttttagaaattcgtgaaattttagaagaacaaaaagctaacatttcagtattccctaaaattgaaaaccaagaaggtattgataatattgcggaaattcttgaagtgtctgatggtttaatggttgcacgtggtgacatgggtgttgaaattccacctgaaaaagtaccaatggttcaaaaagatttaatcagacaatgtaacaaattaggtaaaccagttattacagctacacaaatgttagattctatgcaacgtaacccacgtgctacacgtgcagaagctagtgacgttgccaacgcaatctatgatggtacagatgcagtaatgttatctggtgaaactgctgctggtttatatcctgaagaagctgttaaaacaatgagaaatattgctgtatcagctgaagcagcccaagattacaaaaagttattgtcagatcgtactaaattagttgaaacttcattagtgaatgctatcggtatttcggttgcacatacagctttaaacttaaatgttaaagcaattgtagctgctactgaaagtggttcaacggcacgtactatctccaaatatcgtccacattcagacattattgcggtgactccaagtgaagaaactgcacgtcaatgttcaattgtttggggagttcaacctgtagttaaaaaaggacgtaagagtacagatgcattgttaaacaatgcagttgcaacagctgttgaaactggtagagtatctaatggtgatttaatcattattactgctggtgtaccaactggtgaaactggaactactaatatgatgaaaatccacctagttggtgacgaaattgctaatggtcaaggtattggacgtggatcagttgttggtactacgttagttgctgaaactgttaaagatttagaaggtaaagatttatctgacaaagttatcgttactaactcaatcgatgaaacgtttgtaccttatgtagaaaaagctttaggcttaattacagaagaaaatggtattacatcaccaagtgcaattgttggtttagaaaaaggtattccaacagttgtaggtgtagaaaaagctgttaaaaacataagcaataacatgttagttacgattgatgctgctcaaggtaaaatctttgaaggatatgcaaacgtacta

SEQ ID NO: 5518 - protein, 585 aa, Staphylococcus aureus
  MISC_FEATURE (1)..(585): pyruvate kinase
MRKTKIVCTIGPASESEEMIEKLINAGMNVARLNFSHGSHEEHKGRIDTIRKVAKRLDKIVAILLDTKGPEIRTHNMKDGIIELERGNEVIVSMNEVEGTPEKFSVTYENLINDVQVGSYILLDDGLIELQVKDIDHAKKEVKCDILNSGELKNKKGVNLPGVRVSLPGITEKDAEDIRFGIKENVDFIAASFVRRPSDVLEIREILEEQKANISVFPKIENQEGIDNIAEILEVSDGLMVARGDMGVEIPPEKVPMVQKDLIRQCNKLGKPVITATQMLDSMQRNPRATRAEASDVANAIYDGTDAVMLSGETAAGLYPEEAVKTMRNIAVSAEAAQDYKKLLSDRTKLVETSLVNAIGISVAHTALNLNVKAIVAATESGSTARTISKYRPHSDIIAVTPSEETARQCSIVWGVQPVVKKGRKSTDALLNNAVATAVETGRVSNGDLIIITAGVPTGETGTTNMMKIHLVGDEIANGQGIGRGSVVGTTLVAETVKDLEGKDLSDKVIVTNSIDETFVPYVEKALGLITEENGITSPSAIVGLEKGIPTVVGVEKAVKNISNNMLVTIDAAQGKIFEGYANVL

SEQ ID NO: 5519 - DNA, 966 bp, Staphylococcus aureus
atgaagaaaattgcagttttaactagtggtggagattcacctggaatgaatgctgccgtaagagcagttgttcgtacagcaatttacaatgaaattgaagtttatggtgtgtatcatggttaccaaggattgttaaatgatgatattcataaacttgaattaggatcagttggggatacgattcagcgtggaggtacattcttgtattcagcaagatgtccagagtttaaggagcaagaagtacgtaaagttgcaatcgaaaacttacgtaaaagagggattgagggccttgtagttattggtggtgacggtagttatcgcggtgcacaacgcatcagtgaggaatgtaaagaaattcaaactatcggtattcctggtacgattgacaatgatatcaatggtactgattttacaattggatttgacacagcattaaatacgattattggcttagtcgacaaaattagagatactgcgtcaagtcacgcacgaacatttatcattgaagcaatgggccgtgattgtggagatctagcattatgggctggattatcagttggtgctgagacaattgtagttccagaagtgaaaacagatattaaagaaatagctgataaaattgaacaaggtattaaacgtggtaagaaacactcaatcgttcttgtagcagaaggttgtatgactgcgcaagattgtcaaaaagaattatcacaatacatcaatgttgataatagagtgtctgtgttaggtcacgttcaacgtggtggtagcccaacaggtgcggatagagttttagcatcacgtttaggtggatatgcggtagacttattaatgcaaggtgaaacagctaagggtgttggaattaagaacaataaaattgtagcaacatcttttgatgaaatttttgatggtaaagatcataaatttgattatagtctatatgaacttgctaacaagttatctata

SEQ ID NO: 5520 - protein, 322 aa, Staphylococcus aureus
  MISC_FEATURE (1)..(322): 6-phosphofructokinase
MKKIAVLTSGGDSPGMNAAVRAVVRTAIYNEIEVYGVYHGYQGLLNDDIHKLELGSVGDTIQRGGTFLYSARCPEFKEQEVRKVAIENLRKRGIEGLVVIGGDGSYRGAQRISEECKEIQTIGIPGTIDNDINGTDFTIGFDTALNTIIGLVDKIRDTASSHARTFIIEAMGRDCGDLALWAGLSVGAETIVVPEVKTDIKEIADKIEQGIKRGKKHSIVLVAEGCMTAQDCQKELSQYINVDNRVSVLGHVQRGGSPTGADRVLASRLGGYAVDLLMQGETAKGVGIKNNKIVATSFDEIFDGKDHKFDYSLYELANKLSI

SEQ ID NO: 5521 - DNA, 942 bp, Staphylococcus aureus
atgttagattttgaaaaaccactttttgaaattcgaaataaaattgaatctttaaaagaatctcaagataaaaatgatgtggatttacaagaagaaattgacatgcttgaagcgtcattggaacgagaaactaaaaaaatatatacaaatctaaaaccatgggatcgtgtgcaaattgcgcgtttgcaagaaagacctacgaccctagattatattccatatatctttgattcgtttatggaactacatggtgatcgtaattttagagatgatccagcaatgattggtggtattggctttttaaatggtcgtgctgttacagttattggacaacaacgtggaaaagatacaaaagataatatttatcgaaattttggtatggcgcatccagaaggttatcgaaaagcattacgtttaatgaaacaagctgaaaaattcaatcgtcctatctttacatttatagatacaaaaggtgcatatcctggtaaagctgctgaagaacgtggacaaagtgaatctatcgcaacaaatttgattgagatggcttcattaaaagtaccagttattgcgattgtcattggtgaaggtggcagtggaggtgctctaggtattggtattgccaataaagtattgatgttagagaatagtacttactctgttatatctcctgaaggtgcagcggcattattatggaaagacagtaatttggctaaaattgcagctgaaacaatgaaaattactgcccatgatattaagcaattaggtattatagatgatgtcatttctgaaccacttggcggtgcacataaagatattgaacagcaagctttagctattaaatcagcgtttgttgcacagttagattcacttgagtcattatcacgtgatgaaattgctaatgatcgctttgaaaaattcagaaatatcggttcttatatagaa

SEQ ID NO: 5522 - protein, 314 aa, Staphylococcus aureus
  MISC_FEATURE (1)..(314): acetyl-CoA carboxylase
MLDFEKPLFEIRNKIESLKESQDKNDVDLQEEIDMLEASLERETKKIYTNLKPWDRVQIARLQERPTTLDYIPYIFDSFMELHGDRNFRDDPAMIGGIGFLNGRAVTVIGQQRGKDTKDNIYRNFGMAHPEGYRKALRLMKQAEKFNRPIFTFIDTKGAYPGKAAEERGQSESIATNLIEMASLKVPVIAIVIGEGGSGGALGIGIANKVLMLENSTYSVISPEGAAALLWKDSNLAKIAAETMKITAHDIKQLGIIDDVISEPLGGAHKDIEQQALAIKSAFVAQLDSLESLSRDEIANDRFEKFRNIGSYIE

SEQ ID NO: 5523 - DNA, 855 bp, Staphylococcus aureus
atgtttaaagatttttttaatcgaacaaagaaaaagaaatatcttacagtacaagactctaaaaataatgatgtgcctgcaggtattatgactaagtgtccaaagtgtaagaaaattatgtacacaaaagaattagctgaaaatttaaatgtgtgctttaattgtgatcatcatattgctttaactgcgtataaacgtatagaagcaatttctgatgaaggatcatttacagaattcgataagggaatgacctctgcgaatccattagattttccaagttatttagaaaaaattgaaaaggaccaacaaaagacaggtcttaaagaagcagttgtgactggtacagcacaactagatggtatgaaatttggcgttgctgtcatggattcacgttttagaatgggaagtatgggatcggttatcggtgaaaagatatgtcgcatcattgattactgcactgagaaccgtttaccatttattcttttctctgcaagtggtggtgcacgtatgcaagaaggtattatttccttgatgcaaatgggtaaaaccagtgtatctttaaaacgtcattctgacgctggactattatatatatcatatttaacacatccaactactggtggtgtatctgcaagttttgcatcagttggtgatataaatttaagtgagccaaaagcgttgataggttttgcaggtcgtcgagttattgaacagacaataaacgaaaaattgccagatgatttccaaactgcagaatttttattagagcatggacaattggataaagttgtacatcgtaatgatatgcgtcaaacattgtctgaaattctaaaaatccatcaagaggtgactaaa

SEQ ID NO: 5524 - protein, 285 aa, Staphylococcus aureus
  MISC_FEATURE (1)..(285): acetyl-CoA carboxylase
MFKDFFNRTKKKKYLTVQDSKNNDVPAGIMTKCPKCKKIMYTKELAENLNVCFNCDHHIALTAYKRIEAISDEGSFTEFDKGMTSANPLDFPSYLEKIEKDQQKTGLKEAVVTGTAQLDGMKFGVAVMDSRFRMGSMGSVIGEKICRIIDYCTENRLPFILFSASGGARMQEGIISLMQMGKTSVSLKRHSDAGLLYISYLTHPTTGGVSASFASVGDINLSEPKALIGFAGRRVIEQTINEKLPDDFQTAEFLLEHGQLDKVVHRNDMRQTLSEILKIHQEVTK

SEQ ID NO: 5525 - DNA, 1227 bp, Staphylococcus aureus
atgtcattaagagatgaagcattggaaatgcacaaacgtaatcaaggtaaattagaagttaaaccaaatgtaaaagttactaataaagaggaattaagtttagcatactcacctggcgttgctgaaccgtgtaaagatatttatgaagataaaagaaaagtatatgattacacaattaaaggaaatacagttgcagttattactgatggaacagcggtattaggtttaggtaacattggacctgaagcaagtattcctgtaatggaaggtaaagcagtattattcaaaagcttcgctggtatcaatggggtgcctattgcgttaaatacaactgataccgaagaaatcattaaaacagttaagttgttagaacctaattatggtggtattaatttagaggatatttcggcaccacgttgttttgaaattgaagaacgattgaaaaaagaaactaatattccggtattccatgacgatcaacatggtacagcaattgtaacattggcaggtttggtaaatgcattgagagttgttaacaaagatattgctaaaataaaagttgtactaaatggtgctggtgcagcaggaatagccattgttaaattactatacgcgtatggtgtaagaaatatggttatgtgtgactcaagaggcgcaatttttgaaggacgttcatatggtatgaatcctacgaaagatgttgtagcaaaatggacaaataaagataagattgaagggtctttagaagaagtcgtaaaagacgcagatgtatttatcggggtttctgtagctaatgcgctgtcacaagatatggttaagagtatggcagataatccaattatatttgcaatggctaatccaaatcctgaaataatacctgatgatgccaaagcggcaggtgcacgagttgttggtacaggacgttcagactatcctaaccaaattaataatgtattagctttccctggtatttttagaggtgcattagaggttgaagctacacatataaatgaagaaatgaaaaaggcagctgtagaagcgattgctgatttaatcgatagttctgaattaaatgaagactactgtatcccaggaccgtttgataaacgtgtagcgccatcagttgctcgtaatgttgctaaagcggcaatggaatctggagtagctaggattgaagttgatccgcaagatgtgtatgataaaacaatgaaacttacagatttacaa

SEQ ID NO: 5526 - protein, 409 aa, Staphylococcus aureus
  MISC_FEATURE (1)..(409): malate dehydrogenase
MSLRDEALEMHKRNQGKLEVKPNVKVTNKEELSLAYSPGVAEPCKDIYEDKRKVYDYTIKGNTVAVITDGTAVLGLGNIGPEASIPVMEGKAVLFKSFAGINGVPIALNTTDTEEIIKTVKLLEPNYGGINLEDISAPRCFEIEERLKKETNIPVFHDDQHGTAIVTLAGLVNALRVVNKDIAKIKVVLNGAGAAGIAIVKLLYAYGVRNMVMCDSRGAIFEGRSYGMNPTKDVVAKWTNKDKIEGSLEEVVKDADVFIGVSVANALSQDMVKSMADNPIIFAMANPNPEIIPDDAKAAGARVVGTGRSDYPNQINNVLAFPGIFRGALEVEATHINEEMKKAAVEAIADLIDSSELNEDYCIPGPFDKRVAPSVARNVAKAAMESGVARIEVDPQDVYDKTMKLTDLQ

SEQ ID NO: 5527 - DNA, 3195 bp, Staphylococcus aureus
atggtggcatatttaaatattcatacggcttatgatttgttaaattcaagcttaaaaatagaagatgccgtaagacttgctgtgtctgaaaatgttgatgcacttgccataactgacaccaatgtattgtatggttttcctaaattttatgatgcatgtatagcaaataacattaaaccgatttttggtatgacaatatatgtgacaaatggattaaatacagtcgaaacagttgttctagctaaaaataatgatggattaaaagatttgtatcaactatcatcggaaataaaaatgaatgcattagaacatgtgtcgtttgaattattaaaacgattttctaacaatatgattatcatttttaaaaaagtcggtgatcaacatcgtgatattgtacaagtgtttgaaacccataatgacacatatatggaccaccttagtatttcgattcaaggtagaaaacatgtttggattcaaaatgtttgttaccaaacacgtcaagatgccgatacgatttctgcattagcagctattagagacaatacaaaattagacttaattcatgatcaagaagattttggtgcacattttttaactgaaaaggaaattaatcaattagatattaaccaagaatatttaacgcaggttgatgttatagctcaaaagtgtgatgcagaattaaaatatcatcaatctctacttcctcaatatgagacacctaatgatgaatcagctaaaaaatatttgtggcgtgtcttagttacacaattgaaaaaattagaacttaattatgacgtctatttagagcgattgaaatatgagtataaagttattactaatatgggttttgaagattatttcttaatagtaagtgatttaatccattatgcgaaaacgaatgatgtgatggtaggtcctggtcgtggttcttcagctggctcactggtcagttatttattgggaattacaacgattgatcctattaaattcaatctattatttgaacgttttttaaacccagaacgtgtaacaatgcctgatattgatattgactttgaagatacacgccgagaaagggtcattcagtacgtccaagaaaaatatggcgagctacatgtatctggaattgtgactttcggtcatctgcttgcaagagcagttgctagagatgttggaagaattatggggtttgatgaagttacattaaatgaaatttcaagtttaatcccacataaattaggaattacacttgatgaagcatatcaaattgacgattttaaagagtttgtacatcgaaaccatcgacatgaacgctggttcagtatttgtaaaaagttagaaggtttaccaagacatacatctacacatgcggcaggaattattattaatgaccatccattatatgaatatgcccctttaacgaaaggggatacaggattattaacgcaatggacaatgactgaagccgaacgtattgggttattaaaaatagattttctagggttgagaaacttatcgattattcatcaaatcttaacacaagtcaaaaaagatttaggtattaatattgatatcgaaaagattccgtttgatgatcaaaaagtgtttgaattgttgtcgcaaggagatacgactggcatattccaattagagtctgacggtgtaagaagtgtattaaaaaaattaaagccggaacactttgaagatattgttgctgtaacttctttgtatagaccaggtccaatggaagaaattccaacttacattacaagaagacatgatccaagcaaagttcaatatttacatccgcatttagaacctatattaaaaaatacttacggtgttattatttatcaagagcaaattatgcaaatagcgagcacatttgcaaacttcagttatggtgaagcggatattttaagaagagcaatgagtaaaaaaaatagagctgttcttgaaagtgagcgtcaacattttatagaaggtgcaaagcaaaatggttatcacgaagacattagtaagcaaatatttgatttgattctgaaatttgctgattatggttttcctagagcacatgctgtcagctattctaaaattgcatacattatgagctttttaaaagtccattatccaaattatttttacgcaaatattttaagtaatgttattggaagtgagaagaaaactgctcaaatgatagaagaagcaaaaaaacaaggtatcactatattgccaccgaacattaacgaaagtcattggttttataaaccttcccaagaaggcatttatttatcaattggtacaattaaaggtgttggttatcaaagtgtgaaagtgattgttgatgaacgttatcagaacggcaaatttaaagatttctttgattttgctagacgtataccgaagagagtcaaaacgagaaagttacttgaagcactgattttagtgggagcgtttgatgcttttggtaaaacacgttcaacgttgttgcaagctattgatcaagtgttggatggcgatttaaacattgaacaagatggttttttatttgatattttaacgccaaaacagatgtatgaagataaagaagaattgcctgatgcacttattagtcagtacgaaaaagaatatttaggattttatgtttcgcaacacccagtagataaaaagtttgttgccaaacaatatttaacgatatttaaattgagtaacgcgcagaattataaacctatattagtacagtttgataaagttaaacaaattcgaactaaaaatggtcaaaatatggcattcgtcacattaaatgatggcattgaaactttagatggtgtgattttccctaatcagtttaaaaagtacgaagagttgttatcacataatgacttgtttatagttagcgggaaatttgaccatagaaagcaacaacgtcaactaattataaatgagattcagacattagccacttttgaagaacaaaaattagcatttgccaaacaaattataattagaaataaatcacaaatagatatgtttgaagagatgattaaagctacgaaagagaatgctaatgatgttgtgttatccttttatgatgaaacgattaaacaaatgactactttaggctatattaatcaaaaagatagtatgtttaataattttatacaatcctttaaccctagtgatattaggcttata

SEQ ID NO: 5528 - protein, 1065 aa, Staphylococcus aureus
  MISC_FEATURE (1)..(1065): DNA polymerase III, alpha
MVAYLNIHTAYDLLNSSLKIEDAVRLAVSENVDALAITDTNVLYGFPKFYDACIANNIKPIFGMTIYVTNGLNTVETVVLAKNNDGLKDLYQLSSEIKMNALEHVSFELLKRFSNNMIIIFKKVGDQHRDIVQVFETHNDTYMDHLSISIQGRKHVWIQNVCYQTRQDADTISALAAIRDNTKLDLIHDQEDFGAHFLTEKEINQLDINQEYLTQVDVIAQKCDAELKYHQSLLPQYETPNDESAKKYLWRVLVTQLKKLELNYDVYLERLKYEYKVITNMGFEDYFLIVSDLIHYAKTNDVMVGPGRGSSAGSLVSYLLGITTIDPIKFNLLFERFLNPERVTMPDIDIDFEDTRRERVIQYVQEKYGELHVSGIVTFGHLLARAVARDVGRIMGFDEVTLNEISSLIPHKLGITLDEAYQIDDFKEFVHRNHRHERWFSICKKLEGLPRHTSTHAAGIIINDHPLYEYAPLTKGDTGLLTQWTMTEAERIGLLKIDFLGLRNLSIIHQILTQVKKDLGINIDIEKIPFDDQKVFELLSQGDTTGIFQLESDGVRSVLKKLKPEHFEDIVAVTSLYRPGPMEEIPTYITRRHDPSKVQYLHPHLEPILKNTYGVIIYQEQIMQIASTFANFSYGEADILRRAMSKKNRAVLESERQHFIEGAKQNGYHEDISKQIFDLILKFADYGFPRAHAVSYSKIAYIMSFLKVHYPNYFYANILSNVIGSEKKTAQMIEEAKKQGITILPPNINESHWFYKPSQEGIYLSIGTIKGVGYQSVKVIVDERYQNGKFKDFFDFARRIPKRVKTRKLLEALILVGAFDAFGKTRSTLLQAIDQVLDGDLNIEQDGFLFDILTPKQMYEDKEELPDALISQYEKEYLGFYVSQHPVDKKFVAKQYLTIFKLSNAQNYKPILVQFDKVKQIRTKNGQNMAFVTLNDGIETLDGVIFPNQFKKYEELLSHNDLFIVSGKFDHRKQQRQLIINEIQTLATFEEQKLAFAKQIIIRNKSQIDMFEEMIKATKENANDVVLSFYDETIKQMTTLGYINQKDSMFNNFIQSFNPSDIRLI

SEQ ID NO: 5529 - DNA, 396 bp, Staphylococcus aureus
atgacaatgacagatccaatcgcagatatgcttactcgtgtaagaaacgcaaacatggtgcgtcacgagaagttagaattacctgcatcaaatattaaaaaagaaattgctgaaatcttaaagagtgaaggtttcattaaaaatgttgaatacgtagaagatgataaacaaggtgtacttcgtttattcttaaaatatggtcaaaacgatgagcgtgttatcacaggattaaaacgtatttcaaaaccaggtttacgtgtttatgcaaaagctagcgaaatgcctaaagtattaaatggtttaggtattgcattagtatcaacttctgaaggtgtaatcactgacaaagaagcaagaaaacgtaatgttggtggagaaattatcgcatacgtttgg

SEQ ID NO: 5530 - protein, 132 aa, Staphylococcus aureus
  MISC_FEATURE (1)..(132): 30S ribosomal protein S8
MTMTDPIADMLTRVRNANMVRHEKLELPASNIKKEIAEILKSEGFIKNVEYVEDDKQGVLRLFLKYGQNDERVITGLKRISKPGLRVYAKASEMPKVLNGLGIALVSTSEGVITDKEARKRNVGGEIIAYVW

SEQ ID NO: 5531 - DNA, 981 bp, Staphylococcus aureus
atgcttaaattaagcaacttttctaaaaaagggagtatgaaaatgattagtactttgaatgaaattatgaaatgtatcgaagacaacgatacaattattatacacagacatgttagaccagatcctgatgcatatggttcacaacttggtttaaaatactatattcagcagaaatttccgcaaaagcaagtatttgcagtgggtgaagcggaatcatcattaagttttattggagagttagataacattgatgataaaacatatcaagatgcgcttgtaattgtatgtgatactgccaatgctccacgaattgacgatgaacgttatagtacaggtcgtaaacttattaaaatagatcatcatcctgcagttgatcagtatggtgatattaatttagttaatacgaacgcgtcatctacaagtgaaatcatttacgatttaatctcacattttaatgatgaagcaattgttaataaagatatcgcgagcgttttatatcttggtatcgtcggtgatactgggcgattcctttttaacaatacctcagaacatactatggaaattgctggaaagttaattgggcatgatattgatcataatgcgcttttaaataaaatgatggagaaggacccaaaaatgttgccgtttcaaggttatgttttacaacatttcgaacttatggatgatggattctgccaagttaaaataactgaagatgtattggagcaattcggtattcagccaaatgaagcatctcagtttgttaatacaattgctgacatcaaaggcttgaaaatatgggtatttgcagtcgatgaaggtaatgaaatcagatgtcgattacgttctaaagggcaattgattattaatgatattgcgcaagattttggtggcggtggtcatccgaatgcgtcaggagtttcagtggacagctgggatgaatttgagcaacttgctacagctttacgcacaaaacttaac

SEQ ID NO: 5532 - protein, 327 aa, Staphylococcus aureus
  MISC_FEATURE (1)..(327): conserved hypothetical
MLKLSNFSKKGSMKMISTLNEIMKCIEDNDTIIIHRHVRPDPDAYGSQLGLKYYIQQKFPQKQVFAVGEAESSLSFIGELDNIDDKTYQDALVIVCDTANAPRIDDERYSTGRKLIKIDHHPAVDQYGDINLVNTNASSTSEIIYDLISHFNDEAIVNKDIASVLYLGIVGDTGRFLFNNTSEHTMEIAGKLIGHDIDHNALLNKMMEKDPKMLPFQGYVLQHFELMDDGFCQVKITEDVLEQFGIQPNEASQFVNTIADIKGLKIWVFAVDEGNEIRCRLRSKGQLIINDIAQDFGGGGHPNASGVSVDSWDEFEQLATALRTKLN

SEQ ID NO: 5533 - DNA, 1296 bp, Staphylococcus aureus
atgacaaaacatgaacaaattttagattatattgaatcgttatctataggctctaaaatttcggtgcgtaaaatcgctaaatttttaaacgtatctgaagggacagcatatcgtgcaattaaagatgctgataaaatgggcatggtcgcaacgatagatcgtgttggtacggttcgaatcgaaaaacgtaatcgtaatgaaattgaacatttaacttttaatgaaattgtcaatattattgatggccaagtgttaggtggcaacaaaggtatcactaagatggtatctaaatttgcaattggagcaatggaactcaaagatattttaaagtatattggtccaaagacattattgattgtcggaaatcgtgaagatgtgcagattgaagctttaaaaagaggtacggctatattaattactggtggatttaagccatctaataaagttattaattttgcgaatgaacatgatttacctgttctatcatcaagttatgatacattcctagttgcaaatattatcaacaaagcactttttaatcagaaaatacgaaaagatatcttaatagttcaagatataatgacgccattagatgatttatctgtgctgtttgatacgatgaaaatagcagattataagcgtatggcgaatcgaactggccatacaagatttccggtagtcaatgagtcgtataaattagtaggtattgtaacaagtcgagagatgattaatacaaaggacgacgacgaaatagataaagtgatgacgcgaaatcctatttatgtaaatgctatgagtacagtagcaagttgtgcgcatatgatgatttgggaaggtattgaattgattcctgtcgtttcgagtaataaaaagacagtgggtgtgattaatagacaagatgttttaaagtctatgcaacttttaggaagacagcctcagatgggtgaaacaattaacgatcaaatcgccaaatatataacaatgaatcaagatggaattacagtagaagtttcaccacttttaatcaatcattacggaacagtaagtaaagcggcatttgtaagtattatagaagaaacaatacaatatgaaatgcgtaaatttaaaaaaggtaatgtcatgatagagaacttaaatatcgtgtatattaaaacagtacctattgaatcacatataacagtgcgctttggcatactagacgtcggaagaaacttcgccaaaatagaagtgaacatgcatagtcaaaacgacaaagtagcgagcgctctcgtgatatgccaaatgtttgacgaagta

SEQ ID NO: 5534 - protein, 432 aa, Staphylococcus aureus
  MISC_FEATURE (1)..(432): conserved hypothetical
MTKHEQILDYIESLSIGSKISVRKIAKFLNVSEGTAYRAIKDADKMGMVATIDRVGTVRIEKRNRNEIEHLTFNEIVNIIDGQVLGGNKGITKMVSKFAIGAMELKDILKYIGPKTLLIVGNREDVQIEALKRGTAILITGGFKPSNKVINFANEHDLPVLSSSYDTFLVANIINKALFNQKIRKDILIVQDIMTPLDDLSVLFDTMKIADYKRMANRTGHTRFPVVNESYKLVGIVTSREMINTKDDDEIDKVMTRNPIYVNAMSTVASCAHMMIWEGIELIPVVSSNKKTVGVINRQDVLKSMQLLGRQPQMGETINDQIAKYITMNQDGITVEVSPLLINHYGTVSKAAFVSIIEETIQYEMRKFKKGNVMIENLNIVYIKTVPIESHITVRFGILDVGRNFAKIEVNMHSQNDKVASALVICQMFDEV

SEQ ID NO: 5535 - DNA, 429 bp, Staphylococcus aureus
gtgaggagggatgtactaatgtataaaaatatattacttggtgtagacactcagttaaaaaatgaaaaagcactaaaagaagtgtctaaattagctggcgaaggtacagtcgtaacagttttaaacgcaatcagcgaacaagatgctcaagcatcaattaaagcaggtgttcatttaaacaaacttactgaagaacgaagcaagcgattggaaaaaacacgcaaagctttagaagattatggtattgattatgaccaaataattgttcgtggtaatgcaaaagaagaactattaaaacatgctaatagcggtaaatatgaaattgttgttttaagtaaccgtaaagcagaagacaaaaagaaatttgtacttggaagtgtcagccacaaagtagcaaaacgtgcgactatccctgtattaatcgttaaa

SEQ ID NO: 5536 - protein, 143 aa, Staphylococcus aureus
  MISC_FEATURE (1)..(143): conserved hypothetical
VRRDVLMYKNILLGVDTQLKNEKALKEVSKLAGEGTVVTVLNAISEQDAQASIKAGVHLNKLTEERSKRLEKTRKALEDYGIDYDQIIVRGNAKEELLKHANSGKYEIVVLSNRKAEDKKKFVLGSVSHKVAKRATIPVLIVK

SEQ ID NO: 5537 - DNA, 588 bp, Staphylococcus aureus
ttgaatattgaaacagtgcaggtagactatatcgttttaacgcacggtcattttgatcattttggtgatgttgtggaactagcaaagaaaacaggagcaacagtaattggaagtgcagaaatggctgactatctttcttcatatcacggtgttgaaaatgttcatggtatgaatattggtggtaaagcaaactttgatttcggaagcgttaaatttgttcaagcatttcatagttcaagttttacacatgaaaatggtattccagtttatttaggtatgccaatgggtatcgtgtttgaagttgaaggaaaaacaatttatcatactggtgatacaggtctgtttagtgacatgtcacttattgcgaaacgtcatccagttgatgtatgttttgtaccaattggagataattttacgatgggtattgatgatgcaagttatgctattaatgaatttattaaaccaaaaatttctgtaccgattcattatgatacattcccattaatcgaacaagatccacaacaatttaaagatgctgttaatgtaggggacgtgcaaattttaaaaccaggtgaatctgttcagttt

SEQ ID NO: 5538 - protein, 196 aa, Staphylococcus aureus
  MISC_FEATURE (1)..(196): conserved hypothetical
LNIETVQVDYIVLTHGHFDHFGDVVELAKKTGATVIGSAEMADYLSSYHGVENVHGMNIGGKANFDFGSVKFVQAFHSSSFTHENGIPVYLGMPMGIVFEVEGKTIYHTGDTGLFSDMSLIAKRHPVDVCFVPIGDNFTMGIDDASYAINEFIKPKISVPIHYDTFPLIEQDPQQFKDAVNVGDVQILKPGESVQF

SEQ ID NO: 5539 - DNA, 102 bp, Staphylococcus aureus
ttgataggaggatgctcaaatgaagttatcatttcatggtcaatcaacgatttatttagaagggaacaacaaaaaggttatcgtagatccgtttatttcaaa

SEQ ID NO: 5540 - protein, 34 aa, Staphylococcus aureus
LIGGCSNEVIISWSINDLFRREQQKGYRRSVYFK

SEQ ID NO: 5541 - DNA, 1074 bp, Staphylococcus aureus
atgttgaggagtgtttataaaatgacaaaaatatcaaaaataatagacgaattgaacaatcaacaagctgatgcagcatggattacaacaccgttgaatgtatattattttactggataccgtagcgaaccccatgaaagattatttgcattattgattaagaaagatggtaaacaagtactattttgtccaaaaatggaagtcgaagaagtcaaagcatcacctttcacaggtgaaatcgttggatatttagacactgaaaaccctttttcactttatcctcaaacaatcaataaattactaattgaaagcgagcacttaacagtagcacgccaaaaacaattaatctctggtttcaatgtcaattcattcggagatgttgatttaacaatcaaacaattgagaaatattaaatccgaagatgaaattagcaaaatacgtaaagctgctgagttagcagataagtgtatcgaaataggtgtttcttatttaaaagaaggtgtgactgaatgtgaagtagtcaaccatattgagcaaactatcaaacaatatggcgtcaatgaaatgagttttgatacgatggttttatttggagatcatgccgcatcacctcatggcacaccaggagatcgcagattaaaaagcaatgaatatgtactatttgatttaggtgtaatttatgagcattattgtagcgatatgacacgtactattaaatttggtgaacctagcaaagaagcacaagaaatttataatattgtattagaagcagaaacatctgcaatccaagcaattaaacctggaataccattaaaagatatcgatcatatcgctagaaatattatttcagaaaaaggttatggtgaatatttccctcatcgcttaggtcatggcctaggattacaagaacatgaatatcaagatgtttcaagtactaattctaatttgttagaagctggcatggttattacaatcgaaccaggtatttatgtacctggtgttgcaggtgtaagaattgaagatgacatacttgtcactaatgaaggatatgaagtattaacacattacgaaaaa

SEQ ID NO: 5542 - protein, 358 aa, Staphylococcus aureus
  MISC_FEATURE (1)..(358): Xaa-Pro dipeptidase homolog
MLRSVYKMTKISKIIDELNNQQADAAWITTPLNVYYFTGYRSEPHERLFALLIKKDGKQVLFCPKMEVEEVKASPFTGEIVGYLDTENPFSLYPQTINKLLIESEHLTVARQKQLISGFNVNSFGDVDLTIKQLRNIKSEDEISKIRKAAELADKCIEIGVSYLKEGVTECEVVNHIEQTIKQYGVNEMSFDTMVLFGDHAASPHGTPGDRRLKSNEYVLFDLGVIYEHYCSDMTRTIKFGEPSKEAQEIYNIVLEAETSAIQAIKPGIPLKDIDHIARNIISEKGYGEYFPHRLGHGLGLQEHEYQDVSSTNSNLLEAGMVITIEPGIYVPGVAGVRIEDDILVTNEGYEVLTHYEK

SEQ ID NO: 5543 - DNA, 96 bp, Staphylococcus aureus
atgaatgatattgatttgattcattacatgttactgatgaacatacctgcatatgtgtttctagcttgtttgttacatattgcatttagacttgga

SEQ ID NO: 5544 - protein, 32 aa, Staphylococcus aureus
MNDIDLIHYMLLMNIPAYVFLACLLHIAFRLG

SEQ ID NO: 5545 - DNA, 1125 bp, Staphylococcus aureus
gtggatggtatgaaaattggtataccaagggagattaaaaataatgaaaatcgtgttggtttatcaccaagtggtgtgcacgctttagtagaaagtgggcatactgttttagtggaaacaaatgcgggttcaggatcattctttgaagatgtagattacaaagaagcaggtgctgagattgttgctgaacaagcaaaagtttgggatgtggatatggttattaaagttaaagaaccacttgaatctgaatatccatattttaaagaagggcttgtattattcacttatcttcatttagcaaatgaagaaaaattaacacaagctttgatagatagaaaagtaattagtattgcatatgagactgtgcagttaccagaccgatctttaccattgttatcaccaatgagtgaggtagcaggaagaatgtcagctcaagttggcgcagagttcctacaaaaacttaatggtggtatgggaattctactaggtggtgtcccaggagtacctaagggtaaagtaactattatcggtggtggtcaagcaggaacaaatgcagctaaaattgcactaggactaggtgcagatgttacgattttagatgttaatccaaagcgtttacaacaattagatgatttattcggtggacgtgtacatacaattatgtcaaatccgttgaatattgagttgtatgttaaacaaagtgatttagtaataggtgcagttttaattccaggtgctaaagcgccaagacttgtaacagaagacatgattaaacaaatgaaaaatgggtcagttattattgacattgctattgatcaaggcggtatttttgaaacaactgataaaattacgacacatgatgatcctacatatattaagcatggtgtggttcattatgcagttgcaaatatgccaggtgcagtaccgcgtacttcgacgttagctttaaataatgctacgctaccttatgcgctcatgctagctaataaagggtatagagaagcatttaaatcaaatcaaccattatcattaggtttaaatacttacaaaggtcacgtaaccaataaaggcgttgcagaggcatttgaaatggaatataaatctgtagaagaagcattacaatta

SEQ ID NO: 5546 - protein, 375 aa, Staphylococcus aureus
  MISC_FEATURE (1)..(375): alanine dehydrogenase
VDGMKIGIPREIKNNENRVGLSPSGVHALVESGHTVLVETNAGSGSFFEDVDYKEAGAEIVAEQAKVWDVDMVIKVKEPLESEYPYFKEGLVLFTYLHLANEEKLTQALIDRKVISIAYETVQLPDRSLPLLSPMSEVAGRMSAQVGAEFLQKLNGGMGILLGGVPGVPKGKVTIIGGGQAGTNAAKIALGLGADVTILDVNPKRLQQLDDLFGGRVHTIMSNPLNIELYVKQSDLVIGAVLIPGAKAPRLVTEDMIKQMKNGSVIIDIAIDQGGIFETTDKITTHDDPTYIKHGVVHYAVANMPGAVPRTSTLALNNATLPYALMLANKGYREAFKSNQPLSLGLNTYKGHVTNKGVAEAFEMEYKSVEEALQL

SEQ ID NO: 5547 - DNA, 498 bp, Staphylococcus aureus
atgattacttacaaaaatattttaatcgcagttgacggttcacatgaagcggaatgggcatttaacagagcagttggtgttgctaaacgtaacgatgcgaagttaacaattgtgaatgtaattgattcaagaacgtattcttcttatgaagtttatgatgctcaatttactgaaaaatctaagcattttgcagaagaattattaaatggttataaagaagtagctactaacgctggtgttaaagatgtagaaacgcgtctagagtttggctctcctaaatctatcattcctaaaaagcttgcacatgaaattaatgcagacttgattatgagtggtacatcaggcttaaatgccgtggaaagatttattgttggttctgtatcagaatctatcgttcgtcatgcgccatgtgacgtgttagttgttcgtactgaagagttaccagcagacttccaaccacaagttgcaacaactcaattacgtgaaaaatatcaaaat

SEQ ID NO: 5548 - protein, 166 aa, Staphylococcus aureus
  MISC_FEATURE (1)..(166): conserved hypothetical
MITYKNILIAVDGSHEAEWAFNRAVGVAKRNDAKLTIVNVIDSRTYSSYEVYDAQFTEKSKHFAEELLNGYKEVATNAGVKDVETRLEFGSPKSIIPKKLAHEINADLIMSGTSGLNAVERFIVGSVSESIVRHAPCDVLVVRTEELPADFQPQVATTQLREKYQN

SEQ ID NO: 5549 - DNA, 1137 bp, Staphylococcus aureus
atgcctgaagaggaattagtaacaaaaggtttagtagaaagaatcggattgaaggattcaatttttacaattgaagtcaacggggaaaaagttaaaacagtacaagatatcaaggatcacgttgaggcagttgatatcatgttggatgcttttaaagcgcacaatattattaatgatattaacgatatcgatggaacaggtcaccgtgttgtacatggtggtgaaaaattccctgaatcagtagctattactgatgaggttgaaaaggaaattgaagaattaagcgaattagcaccgcttcacaacccagctaacttgatgggtattcgtgctttccgtaaattattaccaaatatccctcatgtggcaatttttgatacagcattccatcaaacaatgcctgaaaaagcatatctatatagcttgccatatcattattataaagattatggcattcgtaagtatggtttccatggtacaagccataaatttgtatcacaaagagcggcagaaatgttagataagccaattgaagatttacgtattatttcatgtcacattggtaatggagcatcaattgcagctatcgatggcggtaaatctattgatacatcaatgggcttcacaccacttgctggtgtaacaatgggtactcgttctggtaatattgaccctgctttaattccatttattatggaaaaaacaggtaaaactgctgaacaagtattggaaatcttaaacaaagaatcaggtttattaggattatcaggtacatctagtgatttacgtgacttatcagaagaagctgaatcaggtaaagcacgttcacaaatggctttagatgtatttgcttctaaaattcacaaatatattggatcatatgctgcgagaatgcatggtgttgatgttatcgtatttacagcaggtatcggtgaaaactcagtagaaattcgtgcgaaagttcttgaaggcttagaatttatgggtgtttactgggatcctaagaaaaatgaaaacttactacgtggtaaagaaggatttattaactatcctcattcaccagttaaagttgtcgttattccaacagatgaagaaagtatgattgcccgtgatgttatgacattcggtggtttaaaa

SEQ ID NO: 5550 - protein, 379 aa, Staphylococcus aureus
  MISC_FEATURE (1)..(379): acetate kinase homolog
MPEEELVTKGLVERIGLKDSIFTIEVNGEKVKTVQDIKDHVEAVDIMLDAFKAHNIINDINDIDGTGHRVVHGGEKFPESVAITDEVEKEIEELSELAPLHNPANLMGIRAFRKLLPNIPHVAIFDTAFHQTMPEKAYLYSLPYHYYKDYGIRKYGFHGTSHKFVSQRAAEMLDKPIEDLRIISCHIGNGASIAAIDGGKSIDTSMGFTPLAGVTMGTRSGNIDPALIPFIMEKTGKTAEQVLEILNKESGLLGLSGTSSDLRDLSEEAESGKARSQMALDVFASKIHKYIGSYAARMHGVDVIVFTAGIGENSVEIRAKVLEGLEFMGVYWDPKKNENLLRGKEGFINYPHSPVKVVVIPTDEESMIARDVMTFGGLK

SEQ ID NO: 5551 - DNA, 183 bp, Staphylococcus aureus
gtggctaaaacttcaatggttgctaagcaacaaaaaaaacaaaaatatgcagttcgtgaatacactcgttgtgaacgttgtggccgtccacattctgtatatcgtaaatttaaattatgccgtatttgtttccgtgaattagcttacaaaggccaaatccctggcgttcgtaaagctagctgg

SEQ ID NO: 5552 - protein, 61 aa, Staphylococcus aureus
  MISC_FEATURE (1)..(61): 30S ribosomal protein S14
VAKTSMVAKQQKKQKYAVREYTRCERCGRPHSVYRKFKLCRICFRELAYKGQIPGVRKASW

SEQ ID NO: 5553 - DNA, 987 bp, Staphylococcus aureus
ttgctaagacctatgggcactttttattggagagggacgaatatggcagaacaacaaacaattatggaacgcttgtttcatacattagatgaaaaagctaaaacattaaataatgaaaatggccaaagttttattgaaaatcttgggctagcaatggaacaagtatataccaatgaaagaggattgttagaacaatcgacgttacaagatcgacgtaaagcattccaatttgcatatttaagtttaatgcaggaagaaaagatacaagcaaatcatcaaattacaccagattcaattggattgatactaggatttttagttgagcgttttatgaacaaccaagaagaattacatattgttgatattgcaagtggtgccggtcatttaagtgctactgtaaaagaagtgttacctgaaattgcggttatgcatcatttaattgaagttgatccagttttatcacgtgttagtgtacatttagcaaacttcttagaaattcctttcgatgtgtatcctcaagatgccatcatgccactaccattagaagaagcagatatcgttattggtgattttccagtaggctattatccaattgatgaaagaagtaaggagtttaagctaggttttgaagaaggacatagttattcacattatttattaatagaacaagcaataaatgcattaaaagatgctggatatgcctttctagtggtaccaagtaatatttttacaggtgaacatgtaaaacagcttgaaaaatatattgcaacagagacagagatgcaagcatttttaaatttaccaccaactttatttaaaaatgaaaaagcgcgaaaatctatattaattttacaaaagaaaaaatcgggtgaaacaaagccagttgaagtattattggcaaatattcctgatttcaaaattccttcacaatttcaaggatttatgacagagttaaatcagtggatggacacaaatcgtcctaaaaaa

SEQ ID NO: 5554 - protein, 329 aa, Staphylococcus aureus
  MISC_FEATURE (1)..(329): conserved hypothetical
LLRPMGTFYWRGTNMAEQQTIMERLFHTLDEKAKTLNNENGQSFIENLGLAMEQVYTNERGLLEQSTLQDRRKAFQFAYLSLMQEEKIQANHQITPDSIGLILGFLVERFMNNQEELHIVDIASGAGHLSATVKEVLPEIAVMHHLIEVDPVLSRVSVHLANFLEIPFDVYPQDAIMPLPLEEADIVIGDFPVGYYPIDERSKEFKLGFEEGHSYSHYLLIEQAINALKDAGYAFLVVPSNIFTGEHVKQLEKYIATETEMQAFLNLPPTLFKNEKARKSILILQKKKSGETKPVEVLLANIPDFKIPSQFQGFMTELNQWMDTNRPKK

SEQ ID NO: 5555 - DNA, 510 bp, Staphylococcus aureus
atgcaggaggtcaagtatatgactgaaataacattcaaaggtggaccaatccacttaaaaggtcaacaaattaatgaaggtgattttgcacctgattttacagtgttagataatgacttaaatcaagtaacattagcagattatgctggtaaaaagaaattaattagtgtggtaccatcaattgatacaggtgtttgtgatcagcagactcgcaaattcaactctgatgcttctaaagaagaggggattgtgcttacaatttcagcagacttaccattcgcacaaaaaagatggtgcgcttcagcaggtttagacaatgtcattacattaagtgaccaccgtgacttatcatttggtgaaaactatggcgttgttatggaagaacttcgcttattagctcgtgcagtatttgtattagatgcagataataaagttgtttataaagaaatcgttagtgaaggtactgatttcccagattttgatgctgctttagctgcatacaaaaatatt

SEQ ID NO: 5556 - protein, 170 aa, Staphylococcus aureus
  MISC_FEATURE (1)..(170): hypothetical protein
MQEVKYMTEITFKGGPIHLKGQQINEGDFAPDFTVLDNDLNQVTLADYAGKKKLISVVPSIDTGVCDQQTRKFNSDASKEEGIVLTISADLPFAQKRWCASAGLDNVITLSDHRDLSFGENYGVVMEELRLLARAVFVLDADNKVVYKEIVSEGTDFPDFDAALAAYKNI

SEQ ID NO: 5557 - DNA, 768 bp, Staphylococcus aureus
atggatttgaacttaacgatgattataatcataattttatttggttttatcgcggcgtttatagattcggttgtagggggtggcggtttaatttctacgccagcattattagcaatcggtctaccaccatctgtggctttaggtacaaataaattggcaagttcgtttggttctttaactagtacgataaagtttataaggtccggtaaagtggacttatatgttgttgccaaattatttggttttgtatttttggcatctgcatgtggcgcatatattgcaacgatggttccgtcacaaatattgaaacctttaatcatcattgcactttcgtcggtgtttatattcacattacttaaaaaagattggggcaatacacgcacgtttactcaatttacatttaagaaagccataatatttgcagcactttttatattaatcggcttttatgatggatttgtaggtgggggaacaggttcatttatgctttttgtattgttagtctttggttttgattttttaagtgcagcaggaaatgctaaagttttgaactttgcttctaatataggtgcgcttgtattatttatggtattaggacaagtagattatgtaataggtttaattatggctataagtatgattgctgggtcatatgctggggctcattttgctattaaacaaggtgttggttatgtaaaagtattatttattattattactgctattttaattttaaaaaatgcttttgattatattcaacaatttgta

SEQ ID NO: 5558 - protein, 256 aa, Staphylococcus aureus
  MISC_FEATURE (1)..(256): conserved hypothetical
MDLNLTMIIIIILFGFIAAFIDSVVGGGGLISTPALLAIGLPPSVALGTNKLASSFGSLTSTIKFIRSGKVDLYVVAKLFGFVFLASACGAYIATMVPSQILKPLIIIALSSVFIFTLLKKDWGNTRTFTQFTFKKAIIFAALFILIGFYDGFVGGGTGSFMLFVLLVFGFDFLSAAGNAKVLNFASNIGALVLFMVLGQVDYVIGLIMAISMIAGSYAGAHFAIKQGVGYVKVLFIIITAILILKNAFDYIQQFV

SEQ ID NO: 5559 - DNA, 1221 bp, Staphylococcus aureus
atgaagtatgatcacttgcttgttagatacggggagttaacattaaagggttcaaatagaaagaaatttgtaaatcaattaagaaataatgtaaataagtcattaaaaggacttgatgggtttgtcgttaaaggcaaacgagatcgtatgtatattgaacttgaagaccatgcagatataaatgaaataacatatcgattatcaaaaattttcggtattaaatctattagtccagtattaaaagtagaaaaaacaatagaggcaataagtgcagcggcaattaaatttgcgcagcaatttgaagaaaacagcacatttaaaattgatgtgaagcgtgccgataaaaatttcccaatggatacgtatgaattacagcgtgaattgggtggtgcagtattgaagcacttcgacaatatttcagtgaatgtcaaacgtccagatcatgaaattcgagtggaagttagattagatgcaatttatatgtatgaagaagttgttccgggttcaggtggattaccagttggtactggtggtaagacgttactaatgctttcaggcggtatagactcaccagttgctgggatggaagtgatgagacgtggcgtaacaattgaagcgattcatttccatagtccaccatttacaagtgatcaagcaaaagaaaaagttattgaattgacacgtattttagctgaacgtgttggaccaattaaattgcatattgtaccatttacagaattgcaaaaacaggtaaataaagttgtacatccaagatatacaatgacttcaacgagacgtatgatgatgcgtgttgctgataaattagtacatcaaataggggctttagctattgtaaatggtgaaaacctagggcaggtagccagtcaaacacttcatagcatgtatgcaattaataatgtaacttctactcctgtattacgtcctttattaacttacgataaagaagaaattattattaaatcgaaagaaattggtacatttgaaacatctattcaaccatttgaagattgttgtacaattttcacccctaaaaatccagtaaccgaaccaaactttgataaggtagtccaatatgaaagtgtctttgattttgaagagatgattaatcgtgctgttgaaaatattgaaacacttgaaataactagtgattataaaactattaaagaacagcaaacaaaccaattaataaacgacttttta

SEQ ID NO: 5560 - protein, 407 aa, Staphylococcus aureus
  MISC_FEATURE (1)..(407): hypothetical protein
MKYDHLLVRYGELTLKGSNRKKFVNQLRNNVNKSLKGLDGFVVKGKRDRMYIELEDHADINEITYRLSKIFGIKSISPVLKVEKTIEAISAAAIKFAQQFEENSTFKIDVKRADKNFPMDTYELQRELGGAVLKHFDNISVNVKRPDHEIRVEVRLDAIYMYEEVVPGSGGLPVGTGGKTLLMLSGGIDSPVAGMEVMRRGVTIEAIHFHSPPFTSDQAKEKVIELTRILAERVGPIKLHIVPFTELQKQVNKVVHPRYTMTSTRRMMMRVADKLVHQIGALAIVNGENLGQVASQTLHSMYAINNVTSTPVLRPLLTYDKEEIIIKSKEIGTFETSIQPFEDCCTIFTPKNPVTEPNFDKVVQYESVFDFEEMINRAVENIETLEITSDYKTIKEQQTNQLINDFL

SEQ ID NO: 5561 - DNA, 1167 bp, Staphylococcus aureus
ttgatgattaatgaaagagaagtgtttattttgatatatctagataatgcggcaacgacgaaagcatttgaagaagtgttagatacttatttaaaagtaaatcaatcaatgtattataatccgaatagtccgcataaagctggtttgcaggcaaatcaattactacaacaagcaaaaacccaaattaatgcaatgattaattcaaaaacaaattatgatgttgtattcactagtggtgcaactgaatccaataatcttgctttaaaaggtattgcctatcgtaaatttgatacagcgaaggaaataattacatccgtgttagagcatccgtccgtattagaggttgtaagatatttggaagcacacgaaggatttaaagttaaatatgttgatgtaaagaaagatggcagtattaacttagaacacttcaaagaattaatgtcagacaaagtcggtttagtaacatgtatgtatgtaaataatgtaactggacaaatacagcctattccacaaatggctaaagttataaaaaattatcctaaggcacattttcatgtagatgcggttcaagcattcggcaaaatttcaatggatctcaataacatagatagtattagtttaagtggacacaagtttaatggtttaaaaggacaaggcgtcttacttgtaaatcacattcaaaatgttgaaccaactgtccatggtggtggtcaagaatatggtgttagaagtggaacagttaatttgccaaatgatattgcaatggttaaagcgatgaagatagctaatgaaaactttgaagcattgaatgcatttgttactgagttaaataatgacgtccgtcaatttttaaataaatatcatggagtttatattaattcttcaacttcaggttcaccattcgttttaaatattagttttcctggcgtaaaaggtgaagtattagttaatgctttttcaaaatatgacattatgatatctacgacaagtgcttgttcatctaaacgtaataaattaaatgaagtattggctgcaatgggattatcagacaaatctattgaaggtagtataagattatcatttggggctactacaactaaagaagatatagcgaggtttaaagaaatatttatcatcatttatgaggaaattaaggagttgctaaaa

SEQ ID NO: 5562 - protein, 389 aa, Staphylococcus aureus
  MISC_FEATURE (1)..(389): hypothetical protein
LMINEREVFILIYLDNAATTKAFEEVLDTYLKVNQSMYYNPNSPHKAGLQANQLLQQAKTQINAMINSKTNYDVVFTSGATESNNLALKGIAYRKFDTAKEIITSVLEHPSVLEVVRYLEAHEGFKVKYVDVKKDGSINLEHFKELMSDKVGLVTCMYVNNVTGQIQPIPQMAKVIKNYPKAHFHVDAVQAFGKISMDLNNIDSISLSGHKFNGLKGQGVLLVNHIQNVEPTVHGGGQEYGVRSGTVNLPNDIAMVKAMKIANENFEALNAFVTELNNDVRQFLNKYHGVYINSSTSGSPFVLNISFPGVKGEVLVNAFSKYDIMISTTSACSSKRNKLNEVLAAMGLSDKSIEGSIRLSFGATTTKEDIARFKEIFIIIYEEIKELLK

SEQ ID NO: 5563 - DNA, 138 bp, Staphylococcus aureus
gtgattatgcttttttcactacttatattaattaaaacaacacatttgattacgtttatctttaaacaattgctatttatatttattgtccctttcatttatccatataaaaaagaagctagacaacgtatcgttggc

SEQ ID NO: 5564 - protein, 46 aa, Staphylococcus aureus
VIMLFSLLILIKTTHLITFIFKQLLFIFIVPFIYPYKKEARQRIVG

SEQ ID NO: 5565 - DNA, 1692 bp, Staphylococcus aureus
atggtgttatatatcattttggcaataattgtgattatattgattgctgtaggtgtattattctatttacgttcaaataaacgacaaattattgaaaaagcaatcgaacgtaaaaatgaaattgagacgttaccttttgatcaaaaccttgcacaattatctaagttgaatttaaaaggtgaaacaaaaacgaaatacgatgcaatgaaaaaggacaacgtagaaagtacaaataagtatctagctcctgtggaagaaaaaatccataatgctgaggctttattagataaatttagtttcaacgcatctcaaagtgaaattgatgatgcaaatgagttgatggatagttacgaacaaagctatcagcaacaattagaagatgtaaatgaaattattgcgttatacaaagataatgatgaattatatgacaaatgtaaggttgattatcgtgaaatgaaacgtgatgttttagcaaatcgtcatcaatttggtgaggcagcaagtctacttgaaactgaaattgaaaaatttgagccaaggttagagcaatatgaagtactaaaagctgatggtaattatgtacaagcgcacaaccatatagctgccttgaatgaacaaatgaaacagctaagatcttatatggaagaaataccagaattaattagagaaactcaaaaagaattacctggtcaattccaagatttaaaatatggttgccgtgatcttaaagttgaagggtatgatctggatcacgtgaaagtagacagtacattacaaagcttaaaaacagagcttagtttcgttgaaccattaattagccgcttagaattagaagaagctaatgataaactagctaatatcaatgataagttagatgacatgtatgatttaattgaacatgaagttaaagctaaaaatgatgtcgaagaaacaaaagatatcattacggataacttattcaaagctaaagacatgaattatacattgcaaacagaaattgaatatgtacgtgaaaactactatataaatgaatctgatgctcagagtgttcgtcaatttgaaaatgaaattcaaagtttaatttctgtatatgatgatattttaaaagaaatgtctaaatctgctgtgcgatatagcgaggttcaggataatttacaatatttagaagatcatgtcacagttattaatgacaaacaagaaaagctacaaaatcatctgattcaattgcgtgaagatgaagcagaagcagaagacaatctgctacgagtacaatcgaagaaagaagaagtgtatcgtcgattacttgcttctaacttaacaagcgttcctgaaaggtttatcatcatgaaaaatgaaattgatcatgaagttcgtgatgttaacgaacaatttagtgaacgtccaatacacgttaaacagttaaaagataaagtgtctaaaattgtgattcaaatgaatacatttgaagatgaagcaaatgatgttcttgttaatgctgtttatgcagagaaattaattcaatatggaaatagatatcgtaaggactatagcaatgttgataagagcttaaatgaagctgaacgattatttaaaaataatcgctataagcgtgcgattgaaattgcagagcaagctcttgaaagtgttgagccaggtgttactaaacatattgaagaagaagttattaagcaa

SEQ ID NO: 5566 - protein, 564 aa, Staphylococcus aureus
  MISC_FEATURE (1)..(564): hypothetical protein
MVLYIILAIIVIILIAVGVLFYLRSNKRQIIEKAIERKNEIETLPFDQNLAQLSKLNLKGETKTKYDAMKKDNVESTNKYLAPVEEKIHNAEALLDKFSFNASQSEIDDANELMDSYEQSYQQQLEDVNEIIALYKDNDELYDKCKVDYREMKRDVLANRHQFGEAASLLETEIEKFEPRLEQYEVLKADGNYVQAHNHIAALNEQMKQLRSYMEEIPELIRETQKELPGQFQDLKYGCRDLKVEGYDLDHVKVDSTLQSLKTELSFVEPLISRLELEEANDKLANINDKLDDMYDLIEHEVKAKNDVEETKDIITDNLFKAKDMNYTLQTEIEYVRENYYINESDAQSVRQFENEIQSLISVYDDILKEMSKSAVRYSEVQDNLQYLEDHVTVINDKQEKLQNHLIQLREDEAEAEDNLLRVQSKKEEVYRRLLASNLTSVPERFIIMKNEIDHEVRDVNEQFSERPIHVKQLKDKVSKIVIQMNTFEDEANDVLVNAVYAEKLIQYGNRYRKDYSNVDKSLNEAERLFKNNRYKRAIEIAEQALESVEPGVTKHIEEEVIKQ

SEQ ID NO: 5567 - DNA, 465 bp, Staphylococcus aureus
  MISC_FEATURE (1)..(465): n = g, a, t, or c
atgacaacaattaacccaacaaactacacattattaaagaaacaagcagcaagccttattgaagatgaacatcacatgattgctattttaagtaacatgtctgccttattaaatgataatctagatcaaattaattgggttggcttttacttattggaacaaaatgaacttatacttggacctttccaaggacaccccgcttgtgtccacattccaatcggaaaaggtgtatgtggtacagccgtttcagaacgtcgtacacaaattgtagctgatgttcatcaattcgaaggacatatcgcttgtgatgctaatagtaagtctgagattgtcgttccaattttcaaagatgataaaattatcggcgtcttagatatcgatgcccctataacggatcgatttgatgacaatgacaaagaacatcttgaagcaattgttaaaattattaaaagnnnnntaaataat

SEQ ID NO: 5568 - protein, 155 aa, Staphylococcus aureus
  MISC_FEATURE (1)..(155): Xaa = any amino acid
  MISC_FEATURE (1)..(155): conserved hypothetical
MTTINPTNYTLLKKQAASLIEDEHHMIAILSNMSALLNDNLDQINWVGFYLLEQNELILGPFQGHPACVHIPIGKGVCGTAVSERRTQIVADVHQFEGHIACDANSKSEIVVPIFKDDKIIGVLDIDAPITDRFDDNDKEHLEAIVKIIKXXXNN

SEQ ID NO: 5569 - DNA, 246 bp, Staphylococcus aureus
  MISC_FEATURE (1)..(246): n = g, a, t, or c
atggttaaaacagtttatgtaacaggttacaaatcattcgaattaaacatttttaaagatgacgcacctgaagtacattatttaaaacaatttataaaacataaaattgaacaactgttggatgaaggattagaatgggtgttaatacaagggcaaatgggtatagaattatggactgtagaaggtgttattgaattacaacgaacatatgattcgttaaaggttgctgtaatnnnnntaaataat

SEQ ID NO: 5570 - protein, 82 aa, Staphylococcus aureus
  MISC_FEATURE (1)..(82): Xaa = any amino acid
  MISC_FEATURE (1)..(82): conserved hyothetical
MVKTVYVTGYKSFELNIFKDDAPEVHYLKQFIKHKIEQLLDEGLEWVLIQGQMGIELWTVEGVIELQRTYDSLKVAVXXXNN

SEQ ID NO: 5571 - DNA, 399 bp, Staphylococcus aureus
atgacgaatacagtatattgtgataaattaaaaaatgtaggaggcgtcctcatgaatgatgtagtcgaatcactaatttatgaagttaacaacatgcaacaaaattttgaaaatgtgaaatcacaacaacaagatcatgatttttaccaaactgtaaagccatatactgaacatattgatagcatactcaatgagatcaaattacatcgtgaatttattatagaagtaccttatatgaattcaaggaaatttgagctactgattgctaacattgaacaactttctgtcgaatgtcattttaagcgaacaagtcgaaagttatttatagaaaagcttaaaagtgttcaatatgatttacaaaatatattagatggcgtaacaaaagagggtactgatggt

SEQ ID NO: 5572 - protein, 133 aa, Staphylococcus aureus
  MISC_FEATURE (1)..(133): conserved hypothetical
MTNTVYCDKLKNVGGVLMNDVVESLIYEVNNMQQNFENVKSQQQDHDFYQTVKPYTEHIDSILNEIKLHREFIIEVPYMNSRKFELLIANIEQLSVECHFKRTSRKLFIEKLKSVQYDLQNILDGVTKEGTDG

SEQ ID NO: 5573 - DNA, 537 bp, Staphylococcus aureus
ttgaaccgtttaaaagaaaagtttaacactgaagttactgaaaacttaatgaaaaaattcaattatagttcagtaatggaagtaccaaaaatagataaaatcgttgtgaacatgggtgtaggtgacgcagtacaaaattctaaagtattagacaatgctgttgaagaattagaattgatcactggtcaaaaaccattagtaactaaagctaaaaaatcaatcgcgactttccgtttacgtgaaggtatgccaatcggtgcgaaagtaacacttcgcggtgaaagaatgtatgaattcttagacaaattaatttcagtatcattaccacgtgtacgtgacttccaaggtgtttctaaaaaagcatttgacggacgcggtaactacactttaggtgttaaagaacaattaattttcccagaaatcgactatgataaagtaagtaaagttagaggaatggatattgttatcgtaacgactgctaacactgatgaagaagctcgtgaattgttagctaacttcggtatgccattccgtaaa

SEQ ID NO: 5574 - protein, 179 aa, Staphylococcus aureus
  MISC_FEATURE (1)..(179): 50S ribosomal protein L5
LNRLKEKFNTEVTENLMKKFNYSSVMEVPKIDKIVVNMGVGDAVQNSKVLDNAVEELELITGQKPLVTKAKKSIATFRLREGMPIGAKVTLRGERMYEFLDKLISVSLPRVRDFQGVSKKAFDGRGNYTLGVKEQLIFPEIDYDKVSKVRGMDIVIVTTANTDEEARELLANFGMPFRK

SEQ ID NO: 5575 - DNA, 195 bp, Staphylococcus aureus
atgttgtgtataataaacaacgtttactaccaaacttgtgtggtgaaatttatgaattatccaaatggtaaaccatatcgtaaaaatagtgctatagacggagggaaaaagaccgctgcctttagtaatattgagtatggtggacgtggtatgtcacttgaaaaaagatatcgaacattcaaatacgttttatct

SEQ ID NO: 5576 - protein, 65 aa, Staphylococcus aureus
  MISC_FEATURE (1)..(65): recombination protein U
MLCIINNVYYQTCVVKFMNYPNGKPYRKNSAIDGGKKTAAFSNIEYGGRGMSLEKRYRTFKYVLS

SEQ ID NO: 5577 - DNA, 399 bp, Staphylococcus aureus
gtgattaacgaagcttattttcgtacaccttcaacaactgattacaacggcgtttatcaaggttattatattgattttgaagcaaaggaaactaaaaacaagacgtcctttcctttaaataatattcatgaccatcaagtcgaacatatgaaaaatgcatatcaacaaaaaggtattgtgtttttaatgattcgttttaaaacgctagatgaagtttatcttttaccctattcaaaattcgaagtattttggaagagatataaagataatattaaaaagtctataacagttgatgaaatacgaaaaaatggttaccatattccttatcagtatcaaccaagattagactatctaaaagcagttgataagttgatattagatgaaagtgaggaccgcgta

SEQ ID NO: 5578 - protein, 133 aa, Staphylococcus aureus
  MISC_FEATURE (1)..(133): recombination protein U
VINEAYFRTPSTTDYNGVYQGYYIDFEAKETKNKTSFPLNNIHDHQVEHMKNAYQQKGIVFLMIRFKTLDEVYLLPYSKFEVFWKRYKDNIKKSITVDEIRKNGYHIPYQYQPRLDYLKAVDKLILDESEDRV

SEQ ID NO: 5579 - DNA, 2181 bp, Staphylococcus aureus
atgacggaaaacaaaggatcttctcagcctaagaaaaacggtaataatggtgggaaatccaactcaaaaaagaatagaaatgtgaagagaacgattattaagattattggcttcatgattattgcatttttcgttgttcttttactaggtatcttattgtttgcttattatgcttggaaagcacctgcttttaccgaagctaaattacaagatccgattcctgcaaagatatatgacaagaacggagaacttgttaaaacattagataatggccaaagacatgagcatgtaaatttaaaagacgtgccgaaatcaatgaaagacgcagtacttgcaactgaagacaatcgtttctacgaacatggcgcacttgattataaacgtttattcggtgcaattggtaagaacttgactggtggatttggttctgaaggtgcctcaacattaacacaacaagttgttaaagatgcatttttatcacaacataaatctattggacgtaaagctcaagaagcatacttatcatatcgtttagaacaagagtatagtaaagatgatatcttccaagtatatctaaacaaaatttactattctgatggcgtaacaggtattaaagctgctgctaagtattactttaataaagatttaaaagatttaaacttagcggaagaagcttatttagccggtttacctcaggttccaaacaactataatatttatgatcatccaaaagctgctgaagatcgtaaaaacactgttttatacttaatgcattatcataaacgcattacagataaacagtgggaagatgctaagaaaatcgatttaaaagcgaacttagtaaatcgtactcctgaagaacgtcaaaacattgatacaaatcaagattctgagtataattcatacgttaactttgtaaaatctgaattaatgaataataaagcattcaaagatgaaaatttaggtaatgtattacaaagtggtattaaaatttatacaaacatggataaagatgttcaaaaaacattacaaaatgatgttgataatggtagcttctacaagaataaagaccaacaagttggtgcaacaattcttgatagtaaaactggtggtttagttgctatatctggtggacgtgatttcaaagacgtcgttaacagaaaccaagcaacagatcctcaccctactggttcatctttaaaacctttcttagcgtatggacctgccattgaaaatatgaaatgggcaacaaaccatgcgattcaagatgaatcttcatatcaagttgatggttctacatttagaaactatgatacgaagagtcacggtactgtatctatttatgatgctttacgacaaagtttcaatatcccagctttaaaagcttggcaatcagttaagcaaaatgctggtaatgatgcacctaagaaattcgctgccaaacttggcttaaactacgaaggcgatattggtccatctgaagtacttggtggttctgcttcagaattctcaccaacacaattagcatcagcatttgctgcaatcgctaacggtggtacttataacaacgcgcattcaattcaaaaagtagttactcgtgatggtgaaacaatcgaatacgatcatactagccataaagcgatgagtgattacactgcatacatgttagctgagatgctaaaaggtacatttaaaccatatggttctgcatatggccatggtgtatctggagtaaatatgggtgctaagacaggtactggtacttacggtgctgaaacttattcacaatataatttacctgataatgcagcgaaagacgtgtggattaacggctttacacctcaatacactatgtcagtgtggatgggcttcagtaaagttaaacaatatggtgaaaactcatttgtgggacatagccaacaagaatatccacagttcttatatgaaaatgtgatgtcaaaaatttcatctagagatggcgaagactttaaacgtcctagctcagtaagtggtagtatcccatcaatcaatgtttctggtagtcaagataacaacactacaaatcgtagtacacacggtggtagtgacacatcagcaaacagcagtggtactgcacaatcaaataacaatactagatctcaacaatctagaaacagcggtggattaacaggtatattcaac

SEQ ID NO: 5580 - protein, 727 aa, Staphylococcus aureus
  MISC_FEATURE (1)..(727): PBP2 [Staphylococcus aureus
MTENKGSSQPKKNGNNGGKSNSKKNRNVKRTIIKIIGFMIIAFFVVLLLGILLFAYYAWKAPAFTEAKLQDPIPAKIYDKNGELVKTLDNGQRHEHVNLKDVPKSMKDAVLATEDNRFYEHGALDYKRLFGAIGKNLTGGFGSEGASTLTQQVVKDAFLSQHKSIGRKAQEAYLSYRLEQEYSKDDIFQVYLNKIYYSDGVTGIKAAAKYYFNKDLKDLNLAEEAYLAGLPQVPNNYNIYDHPKAAEDRKNTVLYLMHYHKRITDKQWEDAKKIDLKANLVNRTPEERQNIDTNQDSEYNSYVNFVKSELMNNKAFKDENLGNVLQSGIKIYTNMDKDVQKTLQNDVDNGSFYKNKDQQVGATILDSKTGGLVAISGGRDFKDVVNRNQATDPHPTGSSLKPFLAYGPAIENMKWATNHAIQDESSYQVDGSTFRNYDTKSHGTVSIYDALRQSFNIPALKAWQSVKQNAGNDAPKKFAAKLGLNYEGDIGPSEVLGGSASEFSPTQLASAFAAIANGGTYNNAHSIQKVVTRDGETIEYDHTSHKAMSDYTAYMLAEMLKGTFKPYGSAYGHGVSGVNMGAKTGTGTYGAETYSQYNLPDNAAKDVWINGFTPQYTMSVWMGFSKVKQYGENSFVGHSQQEYPQFLYENVMSKISSRDGEDFKRPSSVSGSIPSINVSGSQDNNTTNRSTHGGSDTSANSSGTAQSNNNTRSQQSRNSGGLTGIFN

SEQ ID NO: 5581 - DNA, 339 bp, Staphylococcus aureus
atgacaaatattacaaaagaggtatttgataatttagaacaagagattgatttatttgccaaaaataagacattaggttctagtgaagcaaagccctacttggatgaataccatagtaaaattattgattattttaagcaggttaatgacataactggcaatattgattttgataaattaaatcaatatcctgttgtgccaatgaattttaaagaaagatatgattatatgattgaacgtaaatatcattttatgggctatcgacaaatgaagacctttaaaactgaattgattaaaatgaatgctagttatcaaacaaggttaaagaataagcaggta

SEQ ID NO: 5582 - protein, 113 aa, Staphylococcus aureus
  MISC_FEATURE (1)..(113): hypothetical protein
MTNITKEVFDNLEQEIDLFAKNKTLGSSEAKPYLDEYHSKIIDYFKQVNDITGNIDFDKLNQYPVVPMNFKERYDYMIERKYHFMGYRQMKTFKTELIKMNASYQTRLKNKQV

SEQ ID NO: 5583 - DNA, 660 bp, Staphylococcus aureus
ttgatggtaagtaagaaaaaagcattagaaatgattgatgttatagcaaatatgtttccggatgcagaatgtgaattaaaacatgataatccgttcgaattaactattgctgtattattgtcagcgcaatgtacagacgttctagtaaatagagtaacaactgagctgtttaaaaaatacaaaacgcctgaagattatttggcagtcagtgatgaagaacttatgaatgatattcgttctatcggtctgtatcgtaacaaagctaagaatattaagaaactttgtcaatctttgattgatcaatttaatggagaaataccacaaacacataaggaattagaaagtttagcaggtgtaggacgtaaaactgctaatgtagtcatgagtgtagcatttgatgaaccttcattagctgttgatacgcatgtagaacgtgtttctaaacgcttaggtattaatcgttggaaagataatgtgagacaggtagaagaccgtttatgttctgtcatacctagagatagatggaataggagccatcatcaactcattttctttggaagataccactgtttagcccgaaaacctaaatgcgatatttgtccactattagaagattgtagagaaggacaaaaacgttataaagctagtttgaaagaagcg

SEQ ID NO: 5584 - protein, 220 aa, Staphylococcus aureus
  MISC_FEATURE (1)..(220): endonuclease-like protein
LMVSKKKALEMIDVIANMFPDAECELKHDNPFELTIAVLLSAQCTDVLVNRVTTELFKKYKTPEDYLAVSDEELMNDIRSIGLYRNKAKNIKKLCQSLIDQFNGEIPQTHKELESLAGVGRKTANVVMSVAFDEPSLAVDTHVERVSKRLGINRWKDNVRQVEDRLCSVIPRDRWNRSHHQLIFFGRYHCLARKPKCDICPLLEDCREGQKRYKASLKEA

SEQ ID NO: 5585 - DNA, 684 bp, Staphylococcus aureus
atggataaatatcaattaaaagcaagacctgtagtgatacgaagagaattattagaccattacagtgacttaggtttagatgagcaagatttagtcattttgcttaaattgatttatgcttccgaaacatcaaataaacagccttcaattgaattgcttcagaagggctcaactatgcaaccacgtgatattacaatggttattcaaaatttgatacaacgtgaattgctagaattacaagttcaaaaagatgaagaaggtagatttaccgaatatatgaatctagatccttttttcgaaaaattaagtcatatattgaagcaacaaagtatggaaacgaaagagctaaatagtaaagaaaaatttaaacaattatttagagttttagaggatacatttgcaaggccgttatctccatatgaaatagaaacgttaaatcaatggattgatgttgataaacacgatactgcaattatacaagcggcattagacgaggcgaatagtttgaataaacttagctttaaatatatagatcgtattttacttaattggaagaaaaacaatgtcaaaacaattgacgattctagaaaaataagagaaaaattcaataaaccgaaaatgacgcacacagttaaaacggtacctaaatttgattggttaaacggggagaaccttgatggtaag

SEQ ID NO: 5586 - protein, 228 aa, Staphylococcus aureus
  MISC_FEATURE (1)..(228): hypothetical protein
MDKYQLKARPVVIRRELLDHYSDLGLDEQDLVILLKLIYASETSNKQPSIELLQKGSTMQPRDITMVIQNLIQRELLELQVQKDEEGRFTEYMNLDPFFEKLSHILKQQSMETKELNSKEKFKQLFRVLEDTFARPLSPYEIETLNQWIDVDKHDTAIIQAALDEANSLNKLSFKYIDRILLNWKKNNVKTIDDSRKIREKFNKPKMTHTVKTVPKFDWLNGENLDGK

SEQ ID NO: 5587 - DNA, 1323 bp, Staphylococcus aureus
ttgtataacgaaaaaataaataggagaatggttatgaaaacaacgattaaacaagcgaaagatcatttaaaccaagacgttacaattggtgcttggttaacaaataaacgttcaagtggtaaaatcgcctttttacaattacgtgatggaacaggctttatgcaaggcgtagtagttaaatcagaagttgatgaagaggtattcaaacttgcgaaagaaattactcaagaatcatctctatacgttacaggcacaattacagaagataatcgttctgacttaggatacgaaatgcaagtgaaatcaattgaagttatttcagaagcgcatgactatccgattacacctaaaaatcatggtacagaattcttaatggatcaccgtcatttatggttacgttctaaaaaacaacatgctgtaatgaaaattagaaatgaagttattcgtgcaacgtatgaatttttcaacaaagatggatttacaaaggttgatccaccaattttgacagcaagtgcgccagaaggtacaagtgaattattccatactaaatactttgatcaagatgcgtttttatctcaaagtggtcagttatacttagaagctgcagcaatggcacacggaaaagtattttcatttggtccaactttcagagctgaaaaatcaaaaacacgtagacacttgatcgagttctggatgattgaaggagaaatggctttcacaaatcatgctgaaagtttagaaattcaagaacaatatgtaacacatgttgtaaaatcagttttagaaaattgtaaactagagttgaaaattttagagcgtgatacatcaaaacttgaaaaagttgcgacaccattccctagaatttcatatgatgatgcaattgaattcttaaaagcagaaggctttgatgatattgaatggggcgaagattttggtgcgccacatgaaacagccattgctaatcattatgatttaccggtgtttattactaattatccaactaaaattaagcctttctatatgcaaccaaatcctgaaaatgaagaaactgtattatgtgcagacttaattgcacctgaaggatacggtgaaattattggtggatctgaacgtgtggatgacttagaattgttagaacaacgcgttaaagaacatggattagacgaagaagcatatagttactacttagacttacgtcgttatggtagtgtgccacactgtggatttggtttaggtttagagcgtacagtagcatggatttctggtgttgaacacgttcgtgaaacagcgccattcccaagattattaaaccgtttatatcca

SEQ ID NO: 5588 - protein, 441 aa, Staphylococcus aureus
  MISC_FEATURE (1)..(441): asparaginyl-tRNA synthetase
LYNEKINRRMVMKTTIKQAKDHLNQDVTIGAWLTNKRSSGKIAFLQLRDGTGFMQGVVVKSEVDEEVFKLAKEITQESSLYVTGTITEDNRSDLGYEMQVKSIEVISEAHDYPITPKNHGTEFLMDHRHLWLRSKKQHAVMKIRNEVIRATYEFFNKDGFTKVDPPILTASAPEGTSELFHTKYFDQDAFLSQSGQLYLEAAAMAHGKVFSFGPTFRAEKSKTRRHLIEFWMIEGEMAFTNHAESLEIQEQYVTHVVKSVLENCKLELKILERDTSKLEKVATPFPRISYDDAIEFLKAEGFDDIEWGEDFGAPHETAIANHYDLPVFITNYPTKIKPFYMQPNPENEETVLCADLIAPEGYGEIIGGSERVDDLELLEQRVKEHGLDEEAYSYYLDLRRYGSVPHCGFGLGLERTVAWISGVEHVRETAPFPRLLNRLYP

SEQ ID NO: 5589 - DNA, 2691 bp, Staphylococcus aureus
atgggtatggcaacctatgccgttgtggatttggaaacaacaggcaaccaattagattttgacgatatcattcaaattggtataacgtttgtgcgcaataaccaaattattgatacatatcattctatgattagaacaaatttagagattccgccgttcattcaagcgttaacatccattgaagaaaatatgctacaacaagcgccatattttaatcaagttgcacaagaaatctacgataagataaaagattgcatttttgtagctcataatgtagattttgatttgaattttattaaaaaggcatttaaagattgtaatattcaatatcgtcccaaaaaagttatagatacactagaaatctttaaaatagcttttcctacagataaaagctatcaattaagtgaattagcagaggcacatggtattaccttagcaaatgcccatcgagctgacgaagatgccgctactactgctaaattgatgatattagcttttgaaaaatttgaaaagttaccgttagatactttgaagcaattatattatttaagtaaacagttgaaatacgatttgtatgatattttctttgagatggttaggcaatatgatgcaaagccattggataaatcgtacgaaaagttcgaacagattatctatcgtaagcaagttgattttaaaaagccgacaacaaattataatggcagcttgaagtctttatatagcaaagctgtagatcaacttggcttaacatatcgaccgcaacaattatatttagcggaaactatattagatcagctcatgcatagtgaaaaagcaatgattgaagcatcactaggcagtggtaaatcattagcatatttacttgcggccttgatgtataatattgaaactgggaagcatgtcatgatttctaccaatactaaattactgcaaagtcaattgttagaaaaagatattccagcaatgaatgaagcgttgaattttaaaattaatgcactattgattaaaagtaaaagtgattacatttcattggggcttattagtcaaattttaaaagatgacacaagtaattacgaagtgaatatcttgaaaatgcaattgctgatttggattacagagacgccgtccggagatatacaggaattaaatttaaaaggtggtcaaaagatgtattttgaccagaaaattgaaacatatgtaccggcacgtcacgatgttcattattataattttattaagcgaaatgcacagaacattcaaattggtattacaaatcatgcacatttaattcattctgatgttgaaaattcaatatatcaattgtttgatgattgtatagtggatgaagcacatcgcttaccagactatgccttaaatcaagtgacaaatgagttgagttatgctgatattaaatatcagcttggtttgattggtaaaaacgaaaatgaaaaattgttaaaggcaattgatcaactggaaaagcagcgaattttggaaaaattagatattgcaccaattgatatttttggcttgaaggctagtatgaatgagattcatgagttaaatgagcaattgttctcaacgatatttacgattatcaatgattctgatgtttatgatgatgatattcatcgcttccataatgtatttacttttgaaacaaaagacattttgaaggatttacatgcgattatcgataagttaaataaaacgctagaaatattcaatggcattagtcataaaacagttaaatcattacggaaacagttgttgtatttaaaagataaatttaaaaatatcgaacaaagtttaaaagctggacatactagtttcatttcgattaaaaatttatctcaaaaatcaacaatacgtttatatgtgaaagattacgctgtaaaagatgtattaacgaaacaagtattggaaaaatttaaatcactcatttttatatctggtactttaaaatttaatcattcgtttgaagcttttaaacagttattcaacaaagatgttcactttaatacatttgaagttaacacgtcgttacaaagtgcaaaaaatacaagtgtatttataccgagtgatgtagcatcttatcaatataaaaatatagatgagtatgtagcatcgattgtaagctatattattgaatatacgactataacgtcatcaaaatgtttagtcttatttacgagttataaaatgatgcatatggtacaagatatgctaaatgaattgccagaatttgaagattatgttgtattaacacaacagcagaaccaaaattataaaatagtacaacagtttaataattttgataaggccatactgcttggtacgtcaacattttttgaaggttttgattttcaagcaaatggtattaaatgtgtgatgatagcgaagttaccgtttatgaacaagcataatgcaaaatattggcttatggattctgaattcacttcaactttcaaggaatatgtattacctgatgcagttacacgttttagacaaggacttggaagattaattagaaatgaaaatgatcgcggcataatagtttcatttgatgatcgactcataaacagtaattataaaaacttttttgaacaaacacttgaaaattatcgtcagaaaaaaggcgacattcaacagtttggaaaattattaagacaaattcaaaaaaagaaaaag

SEQ ID NO: 5590 - protein, 897 aa, Staphylococcus aureus
  MISC_FEATURE (1)..(897): probable ATP-dependent DNA
MGMATYAVVDLETTGNQLDFDDIIQIGITFVRNNQIIDTYHSMIRTNLEIPPFIQALTSIEENMLQQAPYFNQVAQEIYDKIKDCIFVAHNVDFDLNFIKKAFKDCNIQYRPKKVIDTLEIFKIAFPTDKSYQLSELAEAHGITLANAHRADEDAATTAKLMILAFEKFEKLPLDTLKQLYYLSKQLKYDLYDIFFEMVRQYDAKPLDKSYEKFEQIIYRKQVDFKKPTTNYNGSLKSLYSKAVDQLGLTYRPQQLYLAETILDQLMHSEKAMIEASLGSGKSLAYLLAALMYNIETGKHVMISTNTKLLQSQLLEKDIPAMNEALNFKINALLIKSKSDYISLGLISQILKDDTSNYEVNILKMQLLIWITETPSGDIQELNLKGGQKMYFDQKIETYVPARHDVHYYNFIKRNAQNIQIGITNHAHLIHSDVENSIYQLFDDCIVDEAHRLPDYALNQVTNELSYADIKYQLGLIGKNENEKLLKAIDQLEKQRILEKLDIAPIDIFGLKASMNEIHELNEQLFSTIFTIINDSDVYDDDIHRFHNVFTFETKDILKDLHAIIDKLNKTLEIFNGISHKTVKSLRKQLLYLKDKFKNIEQSLKAGHTSFISIKNLSQKSTIRLYVKDYAVKDVLTKQVLEKFKSLIFISGTLKFNHSFEAFKQLFNKDVHFNTFEVNTSLQSAKNTSVFIPSDVASYQYKNIDEYVASIVSYIIEYTTITSSKCLVLFTSYKMMHMVQDMLNELPEFEDYVVLTQQQNQNYKIVQQFNNFDKAILLGTSTFFEGFDFQANGIKCVMIAKLPFMNKHNAKYWLMDSEFTSTFKEYVLPDAVTRFRQGLGRLIRNENDRGIIVSFDDRLINSNYKNFFEQTLENYRQKKGDIQQFGKLLRQIQKKKK

SEQ ID NO: 5591 - DNA, 969 bp, Staphylococcus aureus
atgtcaaaatatagtcaagatgtacttcaattactctataaaaataaaccgaattatatatctggacaaagcattgcggaatcacttaatatttcacgcactgcagtaaaaaaagtgattgaccaattaaagttagagggatgtaaaatagattcagtaaatcataaagggcatttattacaacagctcccagatatttggtatcaaggtataatagaccaatatacaaaaagttctgctttgtttgattttagtgaagtatacgattcaatagattctacacaacttgctgcgaaaaagtcacttgttggaaatcaatcttcattttttatcttgagtgatgaacaaacgaaaggtcgtgggcgatttaatagacattggagttcttcaaaagggcaaggactttggatgtctgtcgtgttaagacctaacgttgcattctcaatgatatctaaatttaatttatttattgcattagggataagagatgcgattcaacattttagtcaagatgaagtcaaagtgaaatggccgaatgatatatttattgataatggtaaagtgtgtggtttcttaactgaaatggttgctaataatgatggtatagaagcaataatatgtggtataggtattaatttgacgcaacaactagaaaactttgatgaaagtattagacatagagcaacaagtatacaattacatgataaaaataaattagatagatatcaatttttagagatattacttcaagaaattgaaaaaagatataatcaatttttaacgttacctttttctgaaattcgtgaagaatatactgcagcttctaatatttggaatagaacgttgctatttacagaaaatgataaacagtttaaaggacaagcaattgatttagattacgatggctatctaattgttagagatgaagcgggtgaatcacaccgtttaattagtgcagatatagatttt

SEQ ID NO: 5592 - protein, 323 aa, Staphylococcus aureus
  MISC_FEATURE (1)..(323): hypothetical protein
MSKYSQDVLQLLYKNKPNYISGQSIAESLNISRTAVKKVIDQLKLEGCKIDSVNHKGHLLQQLPDIWYQGIIDQYTKSSALFDFSEVYDSIDSTQLAAKKSLVGNQSSFFILSDEQTKGRGRFNRHWSSSKGQGLWMSVVLRPNVAFSMISKFNLFIALGIRDAIQHFSQDEVKVKWPNDIFIDNGKVCGFLTEMVANNDGIEAIICGIGINLTQQLENFDESIRHRATSIQLHDKNKLDRYQFLEILLQEIEKRYNQFLTLPFSEIREEYTAASNIWNRTLLFTENDKQFKGQAIDLDYDGYLIVRDEAGESHRLISADIDF

SEQ ID NO: 5593 - DNA, 1233 bp, Staphylococcus aureus
atgagcataacaaaagtaaaggcgagtaataatatggataaatcattatttgaacaggcaaggcctatattagaacaaattcaagacaatggttttgaagcatattatgtaggtggctctgtaagagattatgtcatgggaagaaatattcatgatatagatatcacaacaagtgcaacgccggatgaaatagaatctatctttagtcatacgatacctgtaggtaaagaacatggcacgataaatgtagtttttaatgatgaaaattatgaagtgacaacattccgggctgaagaagattatgtcgatcaccgtagaccaagtggtgttacatttgttcgtgatttatacgaagatttgcaacgacgagatttcacgatgaatgcgatagcaatggatacagcatacaaattgtatgattattttgatggtcaacaagatattaataatcgaataataagaactgtaggtatagctgaggaacgattccaagaagatgctttacgtatgattcgatgtttaaggttccagtcacaattatcatttgatattgcaacggaaacattcgaagcgatgcgtatacaaatggcagatattaaatttttatcaattgagcgtatagtgattgaactaactaaattaatgcgaggtattaatgttgaaaagagttttaatcatttaaaatcgctgaaagcatttaattatatgccgtatttcgaacatcttgatatgaatcaaattaatgtaactgaagcaattgatttagaattgttgattgctatagtatcagttaaatttgatattaattactcattgaagcctttaaagctaagtaaccgacaagtaaaagatatcaatcaatatattcaaattatgaatgcattaccaagtattattacaaaagaacaattaaaaatgtttgtttatgattatgatacgcatctcattaaaaatgtaatggttgcagcagacgtgttaaaggcaaatgatattcaaggacatgaaccattaatcgttaaccttcaaacgattgatgaaacattacatcgtttacctatgcataatagaaaagacatgatggttaatggcggtgtacttatggcacatttaaatgccaaaagtggtccgtggttaaaagatgtgctaagacaaattgagatagcgattgtaacaggtaaagtaagcaacgaagaaactgaaattttgaaatgggtggataatcatgtcaaaata

SEQ ID NO: 5594 - protein, 411 aa, Staphylococcus aureus
  MISC_FEATURE (1)..(411): hypothetical protein
MSITKVKASNNMDKSLFEQARPILEQIQDNGFEAYYVGGSVRDYVMGRNIHDIDITTSATPDEIESIFSHTIPVGKEHGTINVVFNDENYEVTTFRAEEDYVDHRRPSGVTFVRDLYEDLQRRDFTMNAIAMDTAYKLYDYFDGQQDINNRIIRTVGIAEERFQEDALRMIRCLRFQSQLSFDIATETFEAMRIQMADIKFLSIERIVIELTKLMRGINVEKSFNHLKSLKAFNYMPYFEHLDMNQINVTEAIDLELLIAIVSVKFDINYSLKPLKLSNRQVKDINQYIQIMNALPSIITKEQLKMFVYDYDTHLIKNVMVAADVLKANDIQGHEPLIVNLQTIDETLHRLPMHNRKDMMVNGGVLMAHLNAKSGPWLKDVLRQIEIAIVTGKVSNEETEILKWVDNHVKI

SEQ ID NO: 5595 - DNA, 315 bp, Staphylococcus aureus
atgcatatcaaaaaaggtgacaacgttaaagttatcgcaggtaaagacaaaggtaaagaaggtaaagtaattgctactctacctaaaaaagaccgtgtcgttgtggaaggtgttaacattatgaaaaaacaccaaaaaccaactcaattaaatcctgaaggtggaatcttagaaacagaggcagcaatccatgtttctaatgtacaattattggaccctaaaacaaacgaaccaactcgtgtaggttacaaatttgttgatggtaaaaaagttcgtatcgctaaaaaatctggcgaagaaattaaatctaataat

SEQ ID NO: 5596 - protein, 105 aa, Staphylococcus aureus
  MISC_FEATURE (1)..(105): 50S ribosomal protein L24
MHIKKGDNVKVIAGKDKGKEGKVIATLPKKDRVVVEGVNIMKKHQKPTQLNPEGGILETEAAIHVSNVQLLDPKTNEPTRVGYKFVDGKKVRIAKKSGEEIKSNN

SEQ ID NO: 5597 - DNA, 1152 bp, Staphylococcus aureus
atgggcaagcgaatgaagataggtataacatgttacccgtccatgggtggttctggaattattgccacagaattaggaattaaattagcagagcgaggtcacgaagtacattttatcacttcaaatatcccgtttagaataagaaaaccattaccgaatatgatttttcatcaagttgaagtgaatcaatatgcagtatttcagtatccaccgtatgatattacgttaagtactaaaatcgctgaagttattaaagaatatgatcttgatttgttgcatatgcactatgctgtacctcatgcaatttgtgggattttagctcgtgagatgtcaggtaaagatataaaaattatgacaacgctacacggtactgatattactgttttgggctatgatcattcactccaaggtgcaattaaatttggcattgaaaaaagtgatattgtgacaagtgtgagtaaatctttagcacaagaaacacatgaaattattgaaactaacaaagaaattataccgatttataattttgtacgtgaaaatgagtttccaactaaacataacacagcattaaaatcacaatttggtatagcaccagatgaaaaagtgttaatacatgtatcgaattttagacaagtaaaacgcatagatactattatagaaacatttgcaaaagtacgtgaaaagatacctagtaaattaattttacttggagatggtcctgaattagtgccaatgcgtcaattgacgaaagagttaaacgtagaagaggatgttttatttttagggaaacaagattgcgtaagtgaattttaccaattatctgacttagtattattattaagtgaaaaagaaagctttggactaactttacttgaggctatgaaaacaggcgtcgttccaattggttcaaatgccggtggaattaaagaggttattaaacatggtgaaactggatttgtcgtagatgtgggtgattgtgattcagcgagtgactatgctatccgattacttgaagataaggtgttatacaacaaacttcagaaaaacatgctagcagatattgctgaacgttttggatcagaacttattacagatcaatatgagtattattatcaaaaaatgctaaatgagcataacaaaagtaaaggcgag

SEQ ID NO: 5598 - protein, 384 aa, Staphylococcus aureus
  MISC_FEATURE (1)..(384): hypothetical protein
MGKRMKIGITCYPSMGGSGIIATELGIKLAERGHEVHFITSNIPFRIRKPLPNMIFHQVEVNQYAVFQYPPYDITLSTKIAEVIKEYDLDLLHMHYAVPHAICGILAREMSGKDIKIMTTLHGTDITVLGYDHSLQGAIKFGIEKSDIVTSVSKSLAQETHEIIETNKEIIPIYNFVRENEFPTKHNTALKSQFGIAPDEKVLIHVSNFRQVKRIDTIIETFAKVREKIPSKLILLGDGPELVPMRQLTKELNVEEDVLFLGKQDCVSEFYQLSDLVLLLSEKESFGLTLLEAMKTGVVPIGSNAGGIKEVIKHGETGFVVDVGDCDSASDYAIRLLEDKVLYNKLQKNMLADIAERFGSELITDQYEYYYQKMLNEHNKSKGE

SEQ ID NO: 5599 - DNA, 315 bp, Staphylococcus aureus
atgaaatcaatggtagaaatgcaacgtgaagttgatgaatatattggacaatttaaaacaggatatttttcaccattagctaacttagctagattgactgaagaagtgggcgaacttgcacgtgaaataaatcatacctatggtgaaaaaaagaagaaagattcagaggaagcaaatacgattaaagcagaattaggtgataatttatttgtgttgttatgtttagcgaattcaatgggaatagatatgacagagagctttaatgaaacaatggaaaagtttaatacaagagataaaaatcgattcgaaagaaag

SEQ ID NO: 5600 - protein, 105 aa, Staphylococcus aureus
  MISC_FEATURE (1)..(105): conserved hypothetical
MKSMVEMQREVDEYIGQFKTGYFSPLANLARLTEEVGELAREINHTYGEKKKKDSEEANTIKAELGDNLFVLLCLANSMGIDMTESFNETMEKFNTRDKNRFERK

SEQ ID NO: 5601 - DNA, 705 bp, Staphylococcus aureus
gtgagtttattgtcttcaatttttactatgataatttatttcgtaatattaatggtgcttcctttatgggcacaacacaaagttaaatctaactatgagaaatattcacaagttagatcaactagtggtaaaacgggtcgtgaagttgcattagaaattttacatgcaaacggtatttatgatgtcgaagttgttaaaggtgaaggattcttaacagatcattacgatcctaaaaagaaagttgtttcactatctcctgcaaactatgacagaccatcagttgctggaactgcaattgcagcccacgaagttggtcatgccattcaagatcaccaaggatattggttcttaagattcagagcagcattagtacctgttgcaaacctagggagttcattaagttatatgatcatcatgttaggtattatcttaacagcgataggtagtgcatttggttcaactgctttatggattggtgctggtttaatgtcattagcggtattattctcaattgttacgttaccagttgagtttgatgcgagttcaagagcgatgaaacaaattacggcattgaacattgtaaatgaaaaagaatacaagcatgcgcgtaaagtattatctgcagcagcaatgacttatgttgcagcaactgcagtcgctgtagcagagcttgtacgtattattttgattgcgcgttcaagtgat

SEQ ID NO: 5602 - protein, 235 aa, Staphylococcus aureus
  MISC_FEATURE (1)..(235): conserved hypothetical
VSLLSSIFTMIIYFVILMVLPLWAQHKVKSNYEKYSQVRSTSGKTGREVALEILHANGIYDVEVVKGEGFLTDHYDPKKKVVSLSPANYDRPSVAGTAIAAHEVGHAIQDHQGYWFLRFRAALVPVANLGSSLSYMIIMLGIILTAIGSAFGSTALWIGAGLMSLAVLFSIVTLPVEFDASSRAMKQITALNIVNEKEYKHARKVLSAAAMTYVAATAVAVAELVRIILIARSSD

SEQ ID NO: 5603 - DNA, 585 bp, Staphylococcus aureus
atgacaattaaagcattttggcaatatacactttatcaacgttcttggttaatgatgctactcatttgtaatatattagggatgatttatggttatatatggtatggtgaacaattaagtcatacgccctggcattttaagatttttgttccagatagcccaactgcaatattatacttagttatttctatctcattgatattaattcaaaaacaaaatagtattatcgatgcactggcatttgtaacattattcaaatatgggatttgggcagttataatgaatatattatttattattgaacaaggtgatattacagtaaatggtttggtattaatgttttcccacagtataatggctgttcaggcaatttacttctatcctaggtttaaacgttctatgattggaatcagtgtagcgatgatttgggtgtttttgaatgattatattgactattttcaccttcaatttccatattatgattttataactacacatgtgtggcaaattggtgtattatcatgttgtctaagtgtttttggacttttgctttatattgaattaaacaaattattaaagtgtaaa

SEQ ID NO: 5604 - protein, 195 aa, Staphylococcus aureus
  MISC_FEATURE (1)..(195): conserved hypothetical
MTIKAFWQYTLYQRSWLMMLLICNILGMIYGYIWYGEQLSHTPWHFKIFVPDSPTAILYLVISISLILIQKQNSIIDALAFVTLFKYGIWAVIMNILFIIEQGDITVNGLVLMFSHSIMAVQAIYFYPRFKRSMIGISVAMIWVFLNDYIDYFHLQFPYYDFITTHVWQIGVLSCCLSVFGLLLYIELNKLLKCK

SEQ ID NO: 5605 - DNA, 615 bp, Staphylococcus aureus
atgacgaattatcaagattgcaatcttaaaatggggtatttgatgtcagagacactcaatcaaattaaagaaagttttattgaatatttactttttcaatatcgatttaagtcgcgtattgcagtttgggtgcttaactatataaaagtgaatgaggcgaaattggcaaacattcattttgtagatacaaaaattaatcatcatgaaacattagaaattgcagaagtgggaagtcacgcttctgcaattcaatttactaagcgtaatataaagttaatgaatacaaatgaaatatttgattatatcgctaatcataactgtgcttttgatattcaaattcacttcgcaaacgtgtcaaagcgtgagcaaaggctagatgatttaatagttgctcaactaacggaatcgcccagttatcaaacttatcttcatgacttaaatagtatggctatagatcggcataaacatgcgttattaatagattacttgttacacaatattgatttaagtttacagatgaatgaaaagcaacgtttttatcaactaacgcaaattttaaatacactcaagctagtaaataaacataatcaatttgaggacttagcagatgacaat

SEQ ID NO: 5606 - protein, 205 aa, Staphylococcus aureus
  MISC_FEATURE (1)..(205): conserved hypothetical
MTNYQDCNLKMGYLMSETLNQIKESFIEYLLFQYRFKSRIAVWVLNYIKVNEAKLANIHFVDTKINHHETLEIAEVGSHASAIQFTKRNIKLMNTNEIFDYIANHNCAFDIQIHFANVSKREQRLDDLIVAQLTESPSYQTYLHDLNSMAIDRHKHALLIDYLLHNIDLSLQMNEKQRFYQLTQILNTLKLVNKHNQFEDLADDN

SEQ ID NO: 5607 - DNA, 1242 bp, Staphylococcus aureus
atggaagatatctataaattaatagacgatatcaatctacaaaaactagaaaatttagactctcgtgttaatgaagcaataactactgacaacgatgacgcattatttattctaggagagacactttacaattttggattaatgccacaaggtttggaagtattccgcgtgttatatcacaaatatccagacgaaagtgaattgctgatttattttattgaaggtttaatgtctgaaaatcaaactgacgaagcgttagaatatttaagttatgttgaaccatcacctgaaaagttgatgttagaagcagatttatatcaacaaattaatatgatggaagttgctattgataaattacaagaagcacttgaactagagccaaatgatccaataatccattttgcattggctgaaatgttatattatgatggtcaatatttacgtgctacctctgaatacgaaaccgttttagaaactggtgaatatcaagttaatggtgtaaacttattctctcgtatggcagattgtagtttacaaagtggtaactatagtgatgcgattcgcttatacgatgaaattaatgaagatgaaatgacttcagaagattatctcaaaaaagccatttcttacgataaaaatgacatcactcaagaagcaattaaaataatgactacattactttctaaagatcctgattatattcaaggctacttgtatttacaatcattatatgaaaatgaaaaaaattatccagatgccattgaaacgggtaaagaaggattacgactaagtcaattttataaagagttaatgtatacaactggatgtttggaaatagaacacggcgatgctaatgaaggtgtattattgttaaaacaagcattagaggttgataatgcttaccaagaacctttattgattttaagcgatttatatcgtaatgaagaagattatgaagcaatcattgaattattaacatatgtagatgaagaagatttggatcctacattcatgtggcatttagcgttcgcctatggtcaagaagagcgagataaagaagctcaacatttctttgaattagcatatccaacgatgaaaacaaatattgattttatgagtgattattatttctatttaattgaaattggtcaaaaggaacaagcaattactattttaaatcaattgttggaactagagccaagtaacgaaaattggcatgacgaattatcaagattgcaatct

SEQ ID NO: 5608 - protein, 414 aa, Staphylococcus aureus
  MISC_FEATURE (1)..(414): conserved hypothetical
MEDIYKLIDDINLQKLENLDSRVNEAITTDNDDALFILGETLYNFGLMPQGLEVFRVLYHKYPDESELLIYFIEGLMSENQTDEALEYLSYVEPSPEKLMLEADLYQQINMMEVAIDKLQEALELEPNDPIIHFALAEMLYYDGQYLRATSEYETVLETGEYQVNGVNLFSRMADCSLQSGNYSDAIRLYDEINEDEMTSEDYLKKAISYDKNDITQEAIKIMTTLLSKDPDYIQGYLYLQSLYENEKNYPDAIETGKEGLRLSQFYKELMYTTGCLEIEHGDANEGVLLLKQALEVDNAYQEPLLILSDLYRNEEDYEAIIELLTYVDEEDLDPTFMWHLAFAYGQEERDKEAQHFFELAYPTMKTNIDFMSDYYFYLIEIGQKEQAITILNQLLELEPSNENWHDELSRLQS

SEQ ID NO: 5609 - DNA, 1305 bp, Staphylococcus aureus
gtgaatgaaatggtaaatgaacaaatcattgatatttcaggtccgttaaagggcgaaatagaagtgccgggcgataagtcaatgacacaccgtgcaatcatgttggcgtcgctagctgaaggtgtatctactatatataagccactacttggcgaagattgtcgtcgtacgatggacattttccgactgttaggtgtagaaatcaaagaagatgatgaaaaattagttgtgacttccccaggatatcaatcttttaacacgccacatcaagtattgtatacaggtaattctggtacgacaacacgattattggcaggtttgttaagtggtttaggtattgaaagtgttttgtctggcgatgtttcaattggtaaaaggccaatggatcgtgtcttgagaccattgaaacttatggatgcgaatattgaaggtattgaagataattatacaccattaattattaagccatctgtcataaaaggtataaattatcaaatggaagttgcaagtgcacaagtaaaaagtgccattttatttgcaagtttgttttctaaggaaccgaccatcattaaagaattagatgtaagtcgaaatcatactgagacgatgttcaaacattttaatattccaattgaagcagaagggttatcaattaatacaacccctgaagcaattcgatacattaaacctgcagattttcatgttcctggcgatatttcatctgcagcgttctttattgttgcagcacttatcacaccaggaagtgatgtaacaattcataatgttggaatcaatccaacacgttcaggtattattgatattgttgaaaaaatgggcggtaatatccaacttttcaatcaaacaactggtgctgaacctactgcttctattcgtattcaatacacaccaatgcttcaaccaataacaatcgaaggagaattagttccaaaagcaattgatgaactgcctgtaatagcattactttgtacacaagcagttggcacgagtacaattaaagatgccgaggaattaaaagtaaaagaaacaaatagaattgatacaacggctgatatgttaaacttgttagggtttgaattacaaccaactaatgatggattgattattcatccgtcagaatttaaaacaaatgcaacagttgatagtttaactgatcatcgaataggaatgatgcttgcagttgcttctctactttcaagcgagcctgtcaaaatcaaacaatttgatgctgtaaatgtatcatttccaggatttttaccaaaactaaagcttttagaaaatgaggga

SEQ ID NO: 5610 - protein, 435 aa, Staphylococcus aureus
  MISC_FEATURE (1)..(435): 3-phosphoshikimate
VNEMVNEQIIDISGPLKGEIEVPGDKSMTHRAIMLASLAEGVSTIYKPLLGEDCRRTMDIFRLLGVEIKEDDEKLVVTSPGYQSFNTPHQVLYTGNSGTTTRLLAGLLSGLGIESVLSGDVSIGKRPMDRVLRPLKLMDANIEGIEDNYTPLIIKPSVIKGINYQMEVASAQVKSAILFASLFSKEPTIIKELDVSRNHTETMFKHFNIPIEAEGLSINTTPEAIRYIKPADFHVPGDISSAAFFIVAALITPGSDVTIHNVGINPTRSGIIDIVEKMGGNIQLFNQTTGAEPTASIRIQYTPMLQPITIEGELVPKAIDELPVIALLCTQAVGTSTIKDAEELKVKETNRIDTTADMLNLLGFELQPTNDGLIIHPSEFKTNATVDSLTDHRIGMMLAVASLLSSEPVKIKQFDAVNVSFPGFLPKLKLLENEG

SEQ ID NO: 5611 - DNA, 1062 bp, Staphylococcus aureus
atgaaattacaaacaacatacccttcaaataattatccaatatatgttgaacacggtgcaattgaccatattagcacgtatattgatcagtttgatcaaagttttatattaattgacgagcatgtaaatcaatattttgctgataaatttgatgatattttatcatatgaaaatgtacataaagttattattccagctggtgaaaagacgaaaacatttgagcaatatcaagaaacattagagtatattttatcccatcatgtaactcgtaatacagcaattattgctgttggtggtggtgcaactggtgattttgctgggtttattgcggcgacacttttacgaggcgtgcactttatacaagtgccaacgactatactagcgcatgattctagtgttggcggtaaagtgggtattaactcaaagcaaggtaaaaaccttatcggtgcattttatcgtccaactgctgtgatttatgatttagtctttttaaagacgttaccatttgagcaaatattaagtggctatgcagaagtttataagcatgcgttattgaatggtgaatcagcgacgcaagatatcgaacagcactttaaagatagagagatattacagtcattaaatggtatggataaatatattgctaaaggtattgaaacgaagctggatattgttattgcagatgaaaaagaacaaggtgtacgtaaatttttaaatttaggtcatacatttggtcatgctgttgaatactatcataaaatacctcatggtcatgcagtgatggttggcattatctatcaatttatagttgcgaatgctttgtttgattctaagcatgatattaatcattatattcaatatttaatacaactcggctatcctttagacatgataactgacttggattttgaaacgttataccaatatatgctaagtgataaaaagaatgataagcaaggtgtacaaatggtcttgattagacaatttggagatatcgttgtacaacatgttgatcaactaacattacaacatgcatgtgaacaattaaaaacatattttaag

SEQ ID NO: 5612 - protein, 354 aa, Staphylococcus aureus
  MISC_FEATURE (1)..(354): 3-dehydroquinate synthase
MKLQTTYPSNNYPIYVEHGAIDHISTYIDQFDQSFILIDEHVNQYFADKFDDILSYENVHKVIIPAGEKTKTFEQYQETLEYILSHHVTRNTAIIAVGGGATGDFAGFIAATLLRGVHFIQVPTTILAHDSSVGGKVGINSKQGKNLIGAFYRPTAVIYDLVFLKTLPFEQILSGYAEVYKHALLNGESATQDIEQHFKDREILQSLNGMDKYIAKGIETKLDIVIADEKEQGVRKFLNLGHTFGHAVEYYHKIPHGHAVMVGIIYQFIVANALFDSKHDINHYIQYLIQLGYPLDMITDLDFETLYQYMLSDKKNDKQGVQMVLIRQFGDIVVQHVDQLTLQHACEQLKTYFK

SEQ ID NO: 5613 - DNA, 1170 bp, Staphylococcus aureus
gtgtgtatgagatacctaacatcaggagaatcacatggacctcaattaacagttattgttgaaggtgtacctgcaaatatagaaattaaggttgaggatattaataaagaaatgtttaagcgtcaaggcggttacggacgtggacgtcgtatgcaaattgagaaagatacagtagaaatagtatcaggcgttagaaatggttatacattaggtagtccaattactatggttgtaaccaatgatgactttacgcattggagaaaaattatgggagcagctccaataagtgaagaagaacgtgaaaatatgaaacgtactattacaaaaccaagacctggtcatgcagatttggttggaggtatgaaatataatcatcgtgatttacgaaatgtgctagagcgatcatctgctagagaaacagcagctcgagttgcagtcggtgccttatgtaaagtgttattacaacagttagatatcgatatatacagtcgtgttgttgaaataggtggaattaaagataaagatttttatgattcagaaacatttaaagcaaatcttgatcgtaatgatgttcgtgtaattgatgacagtatcgcacaagcaatgcgagataaaattgacgaagctaaaaatgaaggagattcaattggcggtgtcgttcaagttgtagttgaaaatatgcctgttggtgtaggtagttatgtgcattatgatcgtaagttagatggtaagattgcacaaggtgttgtcagcataaatgcttttaaaggtgtaagctttggtgaaggatttaaagcagctgaaaagccaggtagtgagattcaagatgaaattctatataatagtgaaattggttattatcgtggatctaatcacttaggtggtttagaaggcggtatgtcaaatggaatgccaattatcgttaatggtgtaatgaaaccaattccaacgttatataaaccattaaattcagtagacattaatactaaagaagactttaaagcaacaattgaacgttctgatagttgtgctgttcctgcagcaagtatcgtctgcgaacatgtcgtagcatttgaaatagcaaaagcattattggaagaattccaatcaaatcatattgagcaacttaaacaacaaattattgagcgcagacaattaaatattgagttt

SEQ ID NO: 5614 - protein, 390 aa, Staphylococcus aureus
  MISC_FEATURE (1)..(390): chorismate synthase
VCMRYLTSGESHGPQLTVIVEGVPANIEIKVEDINKEMFKRQGGYGRGRRMQIEKDTVEIVSGVRNGYTLGSPITMVVTNDDFTHWRKIMGAAPISEEERENMKRTITKPRPGHADLVGGMKYNHRDLRNVLERSSARETAARVAVGALCKVLLQQLDIDIYSRVVEIGGIKDKDFYDSETFKANLDRNDVRVIDDSIAQAMRDKIDEAKNEGDSIGGVVQVVVENMPVGVGSYVHYDRKLDGKIAQGVVSINAFKGVSFGEGFKAAEKPGSEIQDEILYNSEIGYYRGSNHLGGLEGGMSNGMPIIVNGVMKPIPTLYKPLNSVDINTKEDFKATIERSDSCAVPAASIVCEHVVAFEIAKALLEEFQSNHIEQLKQQIIERRQLNIEF

SEQ ID NO: 5615 - DNA, 198 bp, Staphylococcus aureus
atgaagaatattatttcgattattttggggattttaatgttcttaaaattaatggaattactatatggtgctatatttttagataaaccacttaatcctataacaaaaattatttttatactgactctcatttatattttttatgtattagtaaaagaattgattatatttttgaagtcaaagtataacaaaagcgct

SEQ ID NO: 5616 - protein, 66 aa, Staphylococcus aureus
  MISC_FEATURE (1)..(66): hypothetical protein
MKNIISIILGILMFLKLMELLYGAIFLDKPLNPITKIIFILTLIYIFYVLVKELIIFLKSKYNKSA

SEQ ID NO: 5617 - DNA, 366 bp, Staphylococcus aureus
atgatccaacaagaaacacgcttgaaagtagcagacaactctggtgctcgtgaagttcttacaatcaaagtattaggtggatctggtcgtaaaacagcaaacatcggcgatgttatcgtatgtactgttaaaaatgcaacaccaggtggcgttgttaaaaaaggtgacgttgtcaaagctgtaatcgtacgtactaagtcaggtgttcgtcgtaatgacggttcatacatcaaatttgatgaaaatgcatgtgttatcatccgtgatgacaaaggcccacgtggtactcgtatcttcggacctgttgctcgtgaattacgtgaaggtaacttcatgaaaatcgtatcattagcaccagaagtactt

SEQ ID NO: 5618 - protein, 122 aa, Staphylococcus aureus
  MISC_FEATURE (1)..(122): 50S ribosomal protein L14
MIQQETRLKVADNSGAREVLTIKVLGGSGRKTANIGDVIVCTVKNATPGGVVKKGDVVKAVIVRTKSGVRRNDGSYIKFDENACVIIRDDKGPRGTRIFGPVARELREGNFMKIVSLAPEVL

SEQ ID NO: 5619 - DNA, 447 bp, Staphylococcus aureus
gtggaacgtacatttttaatgattaaaccagatgcagtacaaagaaatctaattggtgaagtaatttcaagaattgaaagaaaaggactaaaacttgtcggtggtaaattaatgcaagtaccaatggaacttgctgaaacacattatggtgaacaccaaggtaaaccattttataatgatttaatttcatttattacatcagcaccagtgttcgcaatggtagttgaaggtgaagatgcagttaatgtatctagacatattattggcagcaccaatccttcagaagcttcaccaggatcaattagaggtgatttaggtttaactgttggtagaaatatcattcacggttcagattcattagagtctgctgaacgtgaaattaatctatggtttaatgaaaatgaaattactagctatgcttcaccacgtgatgcatggttatatgaa

SEQ ID NO: 5620 - protein, 149 aa, Staphylococcus aureus
  MISC_FEATURE (1)..(149): nucleoside diphosphate
VERTFLMIKPDAVQRNLIGEVISRIERKGLKLVGGKLMQVPMELAETHYGEHQGKPFYNDLISFITSAPVFAMVVEGEDAVNVSRHIIGSTNPSEASPGSIRGDLGLTVGRNIIHGSDSLESAEREINLWFNENEITSYASPRDAWLYE

SEQ ID NO: 5621 - DNA, 1011 bp, Staphylococcus aureus
ttgctgcaatgcaccttggctataaagaaaaagataataccaaaggtgattaacgtggcaaagttaaacatgaacaatgaaattaagaaagtggaacaacgacttgaaaaggcaataaaaagtaaagattctgtattagaacaggcatcattacacttattgtcttctggtggtaaaagagtacgcccagcatttgttattctgagtagccaatttggcaaagatgaacaaacgtctgaacaaacgtatcaagttgcagtcgcattagagttaattcatatggcaacacttgttcatgatgacgttattgataaaagcgacaagcgtcgaggcaagttaaccatatcaaagaaatgggatcagacaactgctattttaactgggaattttttattggcattaggacttgaacacttaatggccgttaaagataatcgtgtacatcaattgatatctgaatctatcgttgatgtttgtagaggggaacttttccaatttcaagaccaatttaacagtcaacagacaattattaattatttacgacgtatcaatcgcaaaacagcactgttaattcaaatatcaactgaagttggtgcaattacttctcaatctgataaagagactgtacgaaaattgaaaatgattggtcattatataggtatgagcttccaaatcattgatgatgtattagacttcacaagtaccgaaaagaaattaggtaagccggtcggaagtgatttgcttaatggtcatattacgttaccgattttattagaaatgcgtaaaaatccagacttcaaattgaaaatcgaacagttacgtcgtgatagtgaacgcaaagaatttgaagaatgtatccaaatcattagaaaatctgacagcatcgatgaggctaaggcagtaagttcgaagtatttaagtaaagctttgaatttgatttctgagttaccagatggacatccgaaatcactacttttaagtttgacgaaaaaaatgggttcaagaaacacg

SEQ ID NO: 5622 - protein, 337 aa, Staphylococcus aureus
  MISC_FEATURE (1)..(337): heptaprenyl diphosphate
LLQCTLAIKKKIIPKVINVAKLNMNNEIKKVEQRLEKAIKSKDSVLEQASLHLLSSGGKRVRPAFVILSSQFGKDEQTSEQTYQVAVALELIHMATLVHDDVIDKSDKRRGKLTISKKWDQTTAILTGNFLLALGLEHLMAVKDNRVHQLISESIVDVCRGELFQFQDQFNSQQTIINYLRRINRKTALLIQISTEVGAITSQSDKETVRKLKMIGHYIGMSFQIIDDVLDFTSTEKKLGKPVGSDLLNGHITLPILLEMRKNPDFKLKIEQLRRDSERKEFEECIQIIRKSDSIDEAKAVSSKYLSKALNLISELPDGHPKSLLLSLTKKMGSRNT

SEQ ID NO: 5623 - DNA, 723 bp, Staphylococcus aureus
atggctgacaataaagcaaataaagagcaagtacatcgcgtttttcaaaatatttcaaaaaaatatgatagattaaataatattattagttttgagcagcataaagtatggagaaaacgcgtcatgaaagacatgggtgttagaaaagggacgaaagcattagatgtttgttgtggtactggtgattggacaatcgcattaagcaaagctgtaggaccaacaggtgaagttactggtattgactttagtgagaatatgttagaagtaggaaaagaaaaaactgcttcaatggaaaatgttaaacttgttcatggtgatgcaatggaattgccgtttgaagacaattcttttgattatgtaacaattgggtttggattaagaaatgtgccagactatttagtcgcgttaaaagaaatgaatagagtacttaaaccaggtggtatggtggtatgtcttgaaacgagccaaccaactttgccagtctttaaacaaatgtatgcactatactttaaatttgttatgcctatttttggaaaattatttgcaaaatcaaaagaagaatatgaatggttacagcaatctacgtttaattttcctggaaaagaagagttgaagcgcatgtttgaagaagcaggtttcataaatgtaagagtacgtagttttacagggggcgttgctgcaatgcaccttggctataaagaaaaagataataccaaaggtgat

SEQ ID NO: 5624 - protein, 241 aa, Staphylococcus aureus
  MISC_FEATURE (1)..(241): menaquinone biosynthesis
MADNKANKEQVHRVFQNISKKYDRLNNIISFEQHKVWRKRVMKDMGVRKGTKALDVCCGTGDWTIALSKAVGPTGEVTGIDFSENMLEVGKEKTASMENVKLVHGDAMELPFEDNSFDYVTIGFGLRNVPDYLVALKEMNRVLKPGGMVVCLETSQPTLPVFKQMYALYFKFVMPIFGKLFAKSKEEYEWLQQSTFNFPGKEELKRMFEEAGFINVRVRSFTGGVAAMHLGYKEKDNTKGD

SEQ ID NO: 5625 - DNA, 570 bp, Staphylococcus aureus
atggaaacaactgttagcaaattggaaagacaaatagaagaaagattaaagggcgtatcagaatatgaatccattaatattaatcatcggttaggtaagttacttgatttatatgatattccagatgttgccaaagtggcatgcctcacaattgacacatcaatgagacaccttgatgacattacatataatcatttgtctaaacattccattttgattggagatttaattagtgcacatttttatacgctactagcagaaatcaatgatttatcatttcaaaatgaaattagtaaagcaattgttgaaattaatgaattgaaatcttcattacatcatcaagctttaaatgattatgaaatttctcaagcaatagtaaaaattgaaacacttttcccatatattacgttatctcatttcggtatcaatattgatgagtcggaaatatataattatttatttgaagatatgtctgattactatccatcatacttcaagaaatataatcaaagtgaagtaaagcattacttacacgatatccaaaaaagttatttaaaaagtagaggtaat

SEQ ID NO: 5626 - protein, 190 aa, Staphylococcus aureus
  MISC_FEATURE (1)..(190): hypothetical protein
METTVSKLERQIEERLKGVSEYESININHRLGKLLDLYDIPDVAKVACLTIDTSMRHLDDITYNHLSKHSILIGDLISAHFYTLLAEINDLSFQNEISKAIVEINELKSSLHHQALNDYEISQAIVKIETLFPYITLSHFGINIDESEIYNYLFEDMSDYYPSYFKKYNQSEVKHYLHDIQKSYLKSRGN

SEQ ID NO: 5627 - DNA, 270 bp, Staphylococcus aureus
atgaacaaaacagatttaatcaatgcagttgcagagcaagctgatttaactaaaaaagaagctggttcagcagtagatgctgtattcgaatcaatccaaaactcacttgctaaaggtgaaaaagtacaattaattggtttcggtaactttgaggtacgtgaacgtgctgcacgtaaaggtcgtaaccctcaaactggtaaagaaattgatatcccagcaagtaaagttccagcattcaaagctggtaaagcattaaaagatgctgtaaaa

SEQ ID NO: 5628 - protein, 90 aa, Staphylococcus aureus
  MISC_FEATURE (1)..(90): DNA-binding protein II
MNKTDLINAVAEQADLTKKEAGSAVDAVFESIQNSLAKGEKVQLIGFGNFEVRERAARKGRNPQTGKEIDIPASKVPAFKAGKALKDAVK

SEQ ID NO: 5629 - DNA, 996 bp, Staphylococcus aureus
atgactaaaattaccgtttttggtatgggaagttttgggacagcccttgccaatgttcttgcagaaaatggacatgatgttttgatgtggggtaaaaatcaagatgctgttgatgaattaaatacatgtcatacaaataaaaagtatttaaaatacgcgaaattagatgttaacatcatcgctacttcagatatgaccaaagcaattcaatttgcagatatttacttaatggctttacctactaaagcaatgcgagaagttgcttctcaaattaatgataagctgacctctaaaaagacttttatacatgttgctaaaggtattgaaaatgggacgtttaaacgtgtgtcagaaatgattgaagattctatttcacctgaatataatgcaggtattggcgtgttgtcagggccaagtcatgcggaagaagttgtagtcaagcaaccaactacagttgctgcttcatcaaaagataaaagtgtaagtaaattaacgcaagatttatttatgaatgattatttgcgtgtgtacacgaatgatgacttgattggtgttgaacttggtggtgcattgaaaaatatcatcgcagtagcaagtggtatcgtagctggaattggctacggtgataatgcaaaagctgcattaatgactcgtggcttagcggaaattagtagattaggtgaaaagttaggtgccgatcctatgacatttctaggtttaggtggtatcggtgacttaatcgttacttgcacatcaacacattctcggaatttcacattaggatataaacttggacaaggtgaatcaatggatcaagcattatctgaaatgaatatggttgttgaaggtatttatacaactaaatcagtttatcatttagctaaagaaaaaaatgtggatatgccaattacaaatgcattatatagagtattatttgaaaatatctcagtaaaagaatgcgtaaaagatttaatggagcgcgataaaaaatctgaa

SEQ ID NO: 5630 - protein, 332 aa, Staphylococcus aureus
  MISC_FEATURE (1)..(332): glycerol-3-phosphate
MTKITVFGMGSFGTALANVLAENGHDVLMWGKNQDAVDELNTCHTNKKYLKYAKLDVNIIATSDMTKAIQFADIYLMALPTKAMREVASQINDKLTSKKTFIHVAKGIENGTFKRVSEMIEDSISPEYNAGIGVLSGPSHAEEVVVKQPTTVAASSKDKSVSKLTQDLFMNDYLRVYTNDDLIGVELGGALKNIIAVASGIVAGIGYGDNAKAALMTRGLAEISRLGEKLGADPMTFLGLGGIGDLIVTCTSTHSRNFTLGYKLGQGESMDQALSEMNMVVEGIYTTKSVYHLAKEKNVDMPITNALYRVLFENISVKECVKDLMERDKKSE

SEQ ID NO: 5631 - DNA, 1308 bp, Staphylococcus aureus
atgactaaacctatagtagctattgtaggtaggcctaatgtaggtaaatctacaatttttaatagaatagttggagaacgtgtttcgattgtggaagacacgccaggtgtaacacgagatcgtatttattcttcaggtgaatggttaacacatgatttcaatattattgatacaggtggtattgaaattggtgatgcaccattccaaacacaaattagagcgcaggcagaaatcgccatagatgaagcggatgttattatttttatggttaacgtgcgtgaaggattgacacaaagcgatgaaatggtcgctcaaattttatacaaatctaaaaaaccggtcgtattagcggttaacaaagtagataatatggaaatgcgtacagacgtgtatgatttctattcattaggatttggtgaaccgtatccgatatcagggtcacatggtttaggtcttggtgacttgttagatgcagttgtttctcattttggtgaagaggaagaagatccttatgatgaagatacaattcgactatccattattggacgaccaaacgtaggtaaatcaagtttagtaaatgctattttaggtgaagatcgcgttatcgtttctaatgttgcagggacaacgagagacgctattgatacagagtatagttatgatggacaagattatgttttaatcgatactgctggtatgcgtaaaaaaggaaaagtatatgaatcaactgagaaatattcagtattaagagctttaaaagcgattgaacgttcaaatgttgttttagtggtcatagatgcagaacaaggcatcattgaacaagataaacgtgttgcaggatatgcacatgaacaaggtaaagcagtcgtgattgtcgtaaataaatgggatactgtggaaaaagatagtaaaacgatgaagaaatttgaagatgaagtacgtaaagaattccaatttttagattatgcacaaattgcttttgtgtctgctaaagaacgcacaagattacgtacattattcccttacatcaatgaagcaagtgaaaaccataaaaaacgtgttcaaagttcaactttaaatgaagttgttactgatgcaatttccatgaaccctacaccaacagacaaaggtagacgtttgaatgtcttttatgcaacacaagttgctatagaaccaccgacatttgttgtatttgttaatgatgtagaattaatgcatttttcttataaacgctatttagagaatcaaatccgtgccgcttttggttttgaaggtacaccaattcatattatagctcgaaagagaaat

SEQ ID NO: 5632 - protein, 436 aa, Staphylococcus aureus
  MISC_FEATURE (1)..(436): hypothetical protein
MTKPIVAIVGRPNVGKSTIFNRIVGERVSIVEDTPGVTRDRIYSSGEWLTHDFNIIDTGGIEIGDAPFQTQIRAQAEIAIDEADVIIFMVNVREGLTQSDEMVAQILYKSKKPVVLAVNKVDNMEMRTDVYDFYSLGFGEPYPISGSHGLGLGDLLDAVVSHFGEEEEDPYDEDTIRLSIIGRPNVGKSSLVNAILGEDRVIVSNVAGTTRDAIDTEYSYDGQDYVLIDTAGMRKKGKVYESTEKYSVLRALKAIERSNVVLVVIDAEQGIIEQDKRVAGYAHEQGKAVVIVVNKWDTVEKDSKTMKKFEDEVRKEFQFLDYAQIAFVSAKERTRLRTLFPYINEASENHKKRVQSSTLNEVVTDAISMNPTPTDKGRRLNVFYATQVAIEPPTFVVFVNDVELMHFSYKRYLENQIRAAFGFEGTPIHIIARKRN

SEQ ID NO: 5633 - DNA, 1194 bp, Staphylococcus aureus
gtgtataaggaggcaaacaagatgactgaagaattcaatgaatcaatgattaacgatattaaagaaggtgacaaagtcactggcgaggtacaacaagttgaagacaagcaagttgttgttcatatcaacggtggtaaatttaatgggattattcctattagtcaactatctacgcatcatattgatagcccaagtgaagttgtaaaagagggcgacgaagttgaagcatatgtcactaaagttgagtttgatgaagaaaatgaaactggagcttacatcttatctagaagacaacttgaaactgagaagtcttatagttatttacaagaaaaattagataataatgaaatcatcgaagcgaaagtaacagaagtagttaaaggtggtttggttgttgatgtaggacaaagaggttttgttccggcttcactaatttcaacagacttcattgaggatttctctgtgtttgatggacaaacaattcgtattaaagttgaagaattggatcctgaaaataatagagtcattttaagccgtaaagcagttgaacaagaagaaaacgatgctaaaaaagatcaattattacaatctttaaatgaaggcgatgttattgatggtaaagtagcgcgtttaactcaatttggtgcatttatagacattggcggtgttgatggtttagtgcatgtatctgaactttctcacgaacatgttcaaacaccagaagaagtagtttcaattggtcaagatgttaaagttaaaattaaatctattgatagagatacagaacgtatttcattatcaatcaaagatacgttaccaacacctttcgaaaatattaaaggtcaattccacgaaaatgatgtcattgaaggtgtcgtagtaagattggcaaactttggtgcatttgttgaaattgcaccaggtgtacaaggacttgtacatatttctgaaattgcacacaaacacattggtacgccaggtgaagtgttagaacctggtcaacaagtaaatgttaaaatattaggtattgatgaagagaatgaaagagtatcactatctattaaagcaacattaccaaacgaagatgttgttgaaagtgatccttctacgactaaggcgtacttagaaaacgaagaagaagataatccaacaattggcgatatgattggtgataaacttaaaaatcttaaacta

SEQ ID NO: 5634 - protein, 398 aa, Staphylococcus aureus
  MISC_FEATURE (1)..(398): 30S ribosomal protein S1
VYKEANKMTEEFNESMINDIKEGDKVTGEVQQVEDKQVVVHINGGKFNGIIPISQLSTHHIDSPSEVVKEGDEVEAYVTKVEFDEENETGAYILSRRQLETEKSYSYLQEKLDNNEIIEAKVTEVVKGGLVVDVGQRGFVPASLISTDFIEDFSVFDGQTIRIKVEELDPENNRVILSRKAVEQEENDAKKDQLLQSLNEGDVIDGKVARLTQFGAFIDIGGVDGLVHVSELSHEHVQTPEEVVSIGQDVKVKIKSIDRDTERISLSIKDTLPTPFENIKGQFHENDVIEGVVVRLANFGAFVEIAPGVQGLVHISEIAHKHIGTPGEVLEPGQQVNVKILGIDEENERVSLSIKATLPNEDVVESDPSTTKAYLENEEEDNPTIGDMIGDKLKNLKL

SEQ ID NO: 5635 - DNA, 114 bp, Staphylococcus aureus
gtgcaacgcttaacgcatatacaaaatgaatgtgctgataatgatttactcaaattaaaaggtgatttttattcaatgatgaatgaaagttgcctttttatttttggtaaaagt

SEQ ID NO: 5636 - protein, 38 aa, Staphylococcus aureus
VQRLTHIQNECADNDLLKLKGDFYSMMNESCLFIFGKS

SEQ ID NO: 5637 - DNA, 657 bp, Staphylococcus aureus
atgaaagccattaatattgcattagatggtccagctgctgccggaaaaagtacaattgcgaaacgtgtagccagcgaactatcaatgatttatgtcgatacaggagcaatgtatcgtgcattaacatacaaatatttaaaattaaacaaaactgaggactttgcaaaactagttgaccaaacaacattagatttaacttataaagcagataaaggtcaatgtgtcattttagataacgaagatgtaacagactttttaagaaataatgatgtgacgcaacatgtttcatacgttgcatctaaagagccagtacgttcattcgccgttaaaaaacaaaaagagttagctgcagaaaaaggtatcgtaatggatggtcgcgatatcggaactgtagtgctaccagatgcagatttaaaagtatatatgattgcatcagttgaagagcgagcagaaagaagatataaagataatcaattaagaggtatcgaatcaaattttgaagatttaaaacgtgatattgaagctcgtgatcaatatgacatgaaccgtgaaatatcaccattaagaaaagcagatgatgcagtgacattagatacgacaggcaagtcgattgaagaagttactgacgaaattttagcgatggtgagtcaaattaaa

SEQ ID NO: 5638 - protein, 219 aa, Staphylococcus aureus
  MISC_FEATURE (1)..(219): cytidylate kinase
MKAINIALDGPAAAGKSTIAKRVASELSMIYVDTGAMYRALTYKYLKLNKTEDFAKLVDQTTLDLTYKADKGQCVILDNEDVTDFLRNNDVTQHVSYVASKEPVRSFAVKKQKELAAEKGIVMDGRDIGTVVLPDADLKVYMIASVEERAERRYKDNQLRGIESNFEDLKRDIEARDQYDMNREISPLRKADDAVTLDTTGKSIEEVTDEILAMVSQIK

SEQ ID NO: 5639 - DNA, 261 bp, Staphylococcus aureus
gtgagcgaaagaaacgatcgtaaagtttatgtaggtaaagttgtttcagacaaaatggacaagactattacagtacttgttgaaacttacaaaacacacaaattatacggtaaacgagtaaaatactctaaaaaatacaaaactcatgatgaaaacaattcagctaaattaggagacattgttaaaattcaagaaactcgtcctttatcagcaacaaaacgttttcgtttagtagagattgttgaagagtcagtaattatt

SEQ ID NO: 5640 - protein, 87 aa, Staphylococcus aureus
  MISC_FEATURE (1)..(87): 30S ribosomal protein S17
VSERNDRKVYVGKVVSDKMDKTITVLVETYKTHKLYGKRVKYSKKYKTHDENNSAKLGDIVKIQETRPLSATKRFRLVEIVEESVII

SEQ ID NO: 5641 - DNA, 807 bp, Staphylococcus aureus
gtgatggaccagggagttttcccaaaaatgtttaatacaaatcataaaaatgctcagaaatatggcgttattcatgttaatcatcatgaaaatttcgatgatacgggtgcatttaaaaaaagtgagaaatatattattgagaatgcgaataaaattaacggtgtaattgtattaacagaggcacaaagattagatattcttaatcaatttgatgtagaaaatattttcactattagcaattttgttaagatacataatgctccaaaacattttcaaactgaaaaaatcgtaggtcatatttctagaatggtaccaacgaagcgaattgatttgcttattgaagtggctgagttagtcgtaaaaaaagataatgctgttaaatttcatatatatggagaaggatctgtcaaagataaaatagctaaaatgattgaagataaaaatttagaaagaaatgtttttcttaaaggatatacaacaactccacaaaaatgcttggaagattttaaattagtcgtttctacatctcaatatgaaggtcaagggttaagtatgatagaagcaatgatttctaaaaggcctgttgttgcctttgacatcaaatacggaccaagtgattttatagaagataataaaaatggttatttaatagaaaaccataatattaacgacatggctgataaaatacttcagcttgttaataatgatgtattagcagcggagtttggttcgaaagcgagagaaaacattatagaaaaatattcaacggaatcaatattagaaaaatggttaaatcttttcaatagc

SEQ ID NO: 5642 - protein, 269 aa, Staphylococcus aureus
  MISC_FEATURE (1)..(269): hypothetical protein
VMDQGVFPKMFNTNHKNAQKYGVIHVNHHENFDDTGAFKKSEKYIIENANKINGVIVLTEAQRLDILNQFDVENIFTISNFVKIHNAPKHFQTEKIVGHISRMVPTKRIDLLIEVAELVVKKDNAVKFHIYGEGSVKDKIAKMIEDKNLERNVFLKGYTTTPQKCLEDFKLVVSTSQYEGQGLSMIEAMISKRPVVAFDIKYGPSDFIEDNKNGYLIENHNINDMADKILQLVNNDVLAAEFGSKARENIIEKYSTESILEKWLNLFNS
